US011518808B2

(12) United States Patent
Ali et al.

(10) Patent No.: US 11,518,808 B2
(45) Date of Patent: Dec. 6, 2022

(54) ANTI-PD-1 ANTIBODIES AND METHODS OF TREATMENT

(71) Applicant: AMGEN INC., Thousand Oaks, CA (US)

(72) Inventors: Khaled M. K. Z. Ali, Thousand Oaks, CA (US); Neeraj Jagdish Agrawal, Thousand Oaks, CA (US); Gunasekaran Kannan, Thousand Oaks, CA (US); Ian Foltz, Thousand Oaks, CA (US); Zhulun Wang, Thousand Oaks, CA (US); Daren Bates, Thousand Oaks, CA (US); Marissa Mock, Thousand Oaks, CA (US); Shunsuke Takenaka, Thousand Oaks, CA (US)

(73) Assignee: Amgen Inc., Thousand Oaks, CA (US)

( * ) Notice: Subject to any disclaimer, the term of this patent is extended or adjusted under 35 U.S.C. 154(b) by 790 days.

(21) Appl. No.: 16/245,733

(22) Filed: Jan. 11, 2019

(65) Prior Publication Data

US 2019/0270817 A1 Sep. 5, 2019

Related U.S. Application Data

(60) Provisional application No. 62/770,029, filed on Nov. 20, 2018, provisional application No. 62/616,733, filed on Jan. 12, 2018.

(51) Int. Cl.

| | |
|---|---|
| ***C07K 16/28*** | (2006.01) |
| ***A61P 35/00*** | (2006.01) |
| ***A61K 39/395*** | (2006.01) |
| ***C07K 16/06*** | (2006.01) |
| ***C12N 15/85*** | (2006.01) |

(52) U.S. Cl.

CPC ........ *C07K 16/2818* (2013.01); *A61K 39/395* (2013.01); *A61P 35/00* (2018.01); *C07K 16/065* (2013.01); *C07K 16/289* (2013.01); *C12N 15/85* (2013.01); *C07K 2317/24* (2013.01); *C07K 2317/565* (2013.01)

(58) Field of Classification Search

None

See application file for complete search history.

(56) References Cited

U.S. PATENT DOCUMENTS

| | | | |
|---|---|---|---|
| 4,450,150 | A | 5/1984 | Sidman |
| 4,946,778 | A | 8/1990 | Ladner et al. |
| 5,403,484 | A | 4/1995 | Ladner et al. |
| 5,449,752 | A | 9/1995 | Fujii et al. |
| 5,545,806 | A | 8/1996 | Lonberg et al. |
| 5,569,825 | A | 10/1996 | Lonberg et al. |
| 5,571,698 | A | 11/1996 | Ladner et al. |
| 5,702,892 | A | 12/1997 | Mulligan-Kehoe |
| 5,714,352 | A | 2/1998 | Jakobovits |
| 5,780,279 | A | 7/1998 | Matthews et al. |
| 5,821,047 | A | 10/1998 | Garrard et al. |
| 5,824,318 | A | 10/1998 | Mohr et al. |
| 5,824,520 | A | 10/1998 | Mulligan-Kehoe |
| 5,837,500 | A | 11/1998 | Ladner et al. |
| 5,855,885 | A | 1/1999 | Smith et al. |
| 5,858,657 | A | 1/1999 | Winter et al. |
| 5,871,907 | A | 2/1999 | Winter et al. |
| 5,969,108 | A | 10/1999 | McCafferty et al. |
| 6,057,098 | A | 5/2000 | Buechler et al. |
| 6,114,598 | A | 9/2000 | Kucherlapati et al. |
| 6,162,963 | A | 12/2000 | Kucherlapati et al. |
| 6,225,447 | B1 | 5/2001 | Winter et al. |
| 6,265,150 | B1 | 7/2001 | Terstappen et al. |
| 6,706,265 | B1 | 3/2004 | Bolt et al. |
| 6,764,675 | B1 | 7/2004 | Whitley et al. |
| 6,770,274 | B1 | 8/2004 | Martuza et al. |
| 6,833,268 | B1 | 12/2004 | Green et al. |
| 6,929,932 | B2 | 8/2005 | Presnell et al. |
| 7,049,426 | B2 | 5/2006 | Green et al. |
| 7,063,835 | B2 | 6/2006 | Coffin |
| 7,064,244 | B2 | 6/2006 | Jakobovits et al. |
| 7,186,805 | B2 | 3/2007 | Presnell et al. |
| 7,223,593 | B2 | 5/2007 | Coffin |
| 7,276,478 | B2 | 10/2007 | Sivakumar et al. |
| 7,381,803 | B1 | 6/2008 | Weiner et al. |
| 7,410,780 | B2 | 8/2008 | Presnell et al. |
| 7,473,765 | B2 | 1/2009 | Novak et al. |
| 7,494,804 | B2 | 2/2009 | Sprecher et al. |
| 7,728,114 | B2 | 6/2010 | Mach et al. |
| 7,744,899 | B2 | 6/2010 | Whitley et al. |
| 7,749,745 | B2 | 7/2010 | Johnson et al. |
| 7,959,908 | B2 | 6/2011 | Nelson et al. |
| 7,994,289 | B2 | 8/2011 | Waldmann et al. |
| 8,034,326 | B2 | 10/2011 | Hjorth et al. |

(Continued)

FOREIGN PATENT DOCUMENTS

| | | |
|---|---|---|
| CA | 2932966 A1 | 6/2015 |
| CA | 3021372 A1 | 1/2018 |

(Continued)

OTHER PUBLICATIONS

Mariuzza, R.A. etal. The Structural Basis of Antigen-Antibody Recognition1 Annu. Rev. Biophys. Biphys. Chem. 16:139-159, 1987*

(Continued)

*Primary Examiner* — Nora M Rooney

(74) *Attorney, Agent, or Firm* — Julie J. Hong

(57) ABSTRACT

Provided herein are PD-1 antigen-binding proteins and related nucleic acids, vectors, host cells, kits and pharmaceutical compositions. Methods of making PD-1 antigen-binding proteins and methods of treating a subject are further provided.

21 Claims, 44 Drawing Sheets

Specification includes a Sequence Listing.

(56) References Cited

U.S. PATENT DOCUMENTS

| | | | |
|---|---|---|---|
| 8,211,420 | B2 | 7/2012 | Bondensgaard et al. |
| 8,222,374 | B2 | 7/2012 | Sivakumar et al. |
| 8,273,568 | B2 | 9/2012 | Martuza et al. |
| 8,383,367 | B2 | 2/2013 | Hjorth et al. |
| 8,420,071 | B2 | 4/2013 | Whitley et al. |
| 8,470,577 | B2 | 6/2013 | Johnson et al. |
| 8,475,784 | B2 | 7/2013 | Hjorth et al. |
| 8,586,713 | B2 | 11/2013 | Davis et al. |
| 9,388,241 | B2 | 7/2016 | Sivakumar et al. |
| 9,447,159 | B2 | 9/2016 | Ast et al. |
| 10,105,404 | B2 | 10/2018 | Mohr et al. |
| 10,800,825 | B2 | 10/2020 | Lee et al. |
| 11,117,967 | B2 | 9/2021 | Yang et al. |
| 11,136,408 | B2 | 10/2021 | Ekimova et al. |
| 2002/0197266 | A1 | 12/2002 | Debinski |
| 2003/0187225 | A1 | 10/2003 | Penichet et al. |
| 2011/0064751 | A1 | 3/2011 | Mossner et al. |
| 2013/0295113 | A1 | 11/2013 | Mytych et al. |
| 2014/0178905 | A1 | 6/2014 | Walker et al. |
| 2014/0294758 | A1 | 10/2014 | Gillies |
| 2015/0030562 | A1 | 1/2015 | Leonard et al. |
| 2015/0044134 | A1 | 2/2015 | Lossos et al. |
| 2015/0203579 | A1 | 7/2015 | Papadopoulos et al. |
| 2016/0237156 | A1 | 8/2016 | Wang et al. |
| 2017/0121409 | A1 | 5/2017 | Verona et al. |
| 2017/0174779 | A1 | 6/2017 | Varghese et al. |
| 2017/0340708 | A1 | 11/2017 | Xu et al. |
| 2018/0118829 | A1 | 5/2018 | Mabry, III et al. |
| 2019/0218267 | A1 | 7/2019 | Lee et al. |
| 2020/0040080 | A1 | 2/2020 | Yue et al. |

FOREIGN PATENT DOCUMENTS

| | | | |
|---|---|---|---|
| CA | 3036912 | A1 | 3/2018 |
| CN | 1513993 | A | 7/2004 |
| CN | 101208303 | | 3/2006 |
| CN | 101230334 | | 7/2008 |
| CN | 101230335 | | 7/2008 |
| EP | 0623679 | A1 | 11/1994 |
| EP | 1451322 | B1 | 9/2009 |
| EP | 2262837 | A2 | 12/2010 |
| EP | 2262837 | A2 | 12/2010 |
| EP | 1877439 | B1 | 2/2011 |
| EP | 1531850 | B1 | 2/2012 |
| EP | 2109620 | B1 | 8/2012 |
| EP | 1963369 | B1 | 5/2013 |
| EP | 2360181 | B1 | 9/2013 |
| EP | 2567973 | B1 | 5/2014 |
| EP | 2723380 | B1 | 8/2019 |
| KR | 10-2016-0113452 | | 9/2016 |
| WO | WO-1987/005330 | A1 | 9/1987 |
| WO | WO-1996/000007 | A1 | 1/1996 |
| WO | WO-1996/039841 | A1 | 12/1996 |
| WO | WO-1999/007394 | A1 | 2/1999 |
| WO | WO-1999/040942 | A1 | 8/1999 |
| WO | WO-1999/054440 | A1 | 10/1999 |
| WO | WO-2000/032218 | A1 | 6/2000 |
| WO | WO-2000/054795 | A1 | 9/2000 |
| WO | WO-2002/078731 | A1 | 10/2002 |
| WO | WO-2004/033036 | A2 | 4/2004 |
| WO | WO-2004/106381 | A1 | 12/2004 |
| WO | WO-2005/040220 | A1 | 5/2005 |
| WO | WO-2006/002394 | A2 | 1/2006 |
| WO | WO-2006/121168 | A1 | 11/2006 |
| WO | WO-2007/098420 | A2 | 8/2007 |
| WO | 2007/114861 | A2 | 10/2007 |
| WO | 2007/128563 | A1 | 11/2007 |
| WO | WO-2008/119565 | A2 | 10/2008 |
| WO | WO-2008/119567 | A2 | 10/2008 |
| WO | WO-2008/130158 | A1 | 10/2008 |
| WO | WO-2009/127691 | A1 | 10/2009 |
| WO | WO-2010/037836 | A2 | 4/2010 |
| WO | 2010/055366 | A2 | 5/2010 |
| WO | WO-2010/103038 | A1 | 9/2010 |
| WO | 2010/112193 | A1 | 10/2010 |
| WO | 2011/020783 | A2 | 2/2011 |
| WO | WO-2011/051489 | A2 | 5/2011 |
| WO | 2011/109789 | A2 | 9/2011 |
| WO | WO-2012/059486 | A1 | 5/2012 |
| WO | 2012/107416 | A2 | 8/2012 |
| WO | WO-2012/125495 | A2 | 9/2012 |
| WO | 2012/146628 | A1 | 11/2012 |
| WO | WO-2012/150319 | A1 | 11/2012 |
| WO | WO-2013/006795 | A2 | 1/2013 |
| WO | 2013/059885 | A2 | 5/2013 |
| WO | WO-2013/072406 | A1 | 5/2013 |
| WO | WO-2013/075066 | A2 | 5/2013 |
| WO | WO-2013/135896 | A1 | 9/2013 |
| WO | 2013/164694 | A1 | 11/2013 |
| WO | WO-2013/169693 | A1 | 11/2013 |
| WO | 2014/023679 | A1 | 2/2014 |
| WO | WO-2014/072481 | A1 | 5/2014 |
| WO | 2014/139468 | A1 | 9/2014 |
| WO | 2014/179664 | A2 | 11/2014 |
| WO | WO-2015/000585 | A1 | 1/2015 |
| WO | 2015/112800 | A1 | 7/2015 |
| WO | 2015/112900 | A1 | 7/2015 |
| WO | 2015/117930 | A1 | 8/2015 |
| WO | WO-2015/124297 | A1 | 8/2015 |
| WO | 2015/157238 | A2 | 10/2015 |
| WO | 2016/094962 | A1 | 6/2016 |
| WO | 2016/096858 | A1 | 6/2016 |
| WO | 2016/100375 | A2 | 6/2016 |
| WO | 2017/019846 | A1 | 2/2017 |
| WO | 2017/023779 | A1 | 2/2017 |
| WO | 2017/025051 | A1 | 2/2017 |
| WO | WO-2017/021349 | A1 | 2/2017 |
| WO | WO-2017/021362 | A1 | 2/2017 |
| WO | WO-2017/021370 | A1 | 2/2017 |
| WO | 2017/040790 | A1 | 3/2017 |
| WO | 2017/055443 | A1 | 4/2017 |
| WO | 2017/077382 | A1 | 5/2017 |
| WO | 2017/079112 | A1 | 5/2017 |
| WO | 2017/123643 | A1 | 7/2017 |
| WO | WO-2017/118864 | A1 | 7/2017 |
| WO | WO-2017/118865 | A1 | 7/2017 |
| WO | WO-2017/118866 | A1 | 7/2017 |
| WO | WO-2017/118867 | A1 | 7/2017 |
| WO | 2017/134302 | A2 | 8/2017 |
| WO | 2017/136818 | A2 | 8/2017 |
| WO | WO-2017/134134 | A1 | 8/2017 |
| WO | WO-2017/134140 | A1 | 8/2017 |
| WO | WO-2017/134158 | A1 | 8/2017 |
| WO | 2017/158436 | A1 | 9/2017 |
| WO | 2017/165464 | A1 | 9/2017 |
| WO | WO-2017/173410 | A1 | 10/2017 |
| WO | WO-2017/181420 | A1 | 10/2017 |
| WO | WO-2018/006005 | A1 | 1/2018 |
| WO | WO-2018/026872 | A1 | 2/2018 |
| WO | 2018/044105 | A1 | 3/2018 |
| WO | 2018/053709 | A1 | 3/2018 |
| WO | 2018/057943 | A1 | 3/2018 |
| WO | WO-2018/127713 | A1 | 7/2018 |
| WO | 2018/176505 | A1 | 10/2018 |
| WO | 2018/184964 | A1 | 10/2018 |
| WO | 2019/010219 | A1 | 1/2019 |
| WO | 2019/010222 | A2 | 1/2019 |
| WO | 2019/010224 | A1 | 1/2019 |
| WO | 2019/173832 | A2 | 9/2019 |
| WO | 2019/191519 | A1 | 10/2019 |
| WO | 2019/200007 | A1 | 10/2019 |
| WO | 2019/246004 | A1 | 12/2019 |
| WO | 2020/065096 | A1 | 4/2020 |
| WO | 2020/127369 | A1 | 6/2020 |

OTHER PUBLICATIONS

Rudikoff et al. "Single Amino Acid Substitution Altering Antigen-Binding Specificity" PNAS. 79:1979-1983, 1982.*

Rader et al. PNAS. 95:8910-8915, 1998.*

Goel e tal. Plasticity within the Antigen-Combining Site May Manifest as Molecular Mimicry in the Humoral Immune Response.1 J. Immunol. 173(12)7358-7367, 2004.*

(56) References Cited

OTHER PUBLICATIONS

Kahn et al. 'Adjustable Locks and Flexible Keys: Plasticity of Epitope-Paratope Interactions in Germline Antibodies.' J. Immunol. 192:5398-5405, 2014.*
Poosarla et al. 'Computational De Novo Design of Antibodies Binding to a Peptide With High Affinity.' Biotech. Bioeng. 114(6): 1331-1342, 2017.*
MacCallum et al. "Antibody-antigen interactions: contact analysis and binding site topography", Journal of Molecular Biology, 1996. vol. 262, pp. 732-745.*
De Pascalis et al. "Grafting of abbreviated complementarity determining regions containing specificity determining residues essential for ligand contact to engineer a less immunogenic humanzied monoclonal antibody", Journal of Immunology, 2002. vol. 169, pp. 3076-3084.*
U.S. Appl. No. 62/655,725.
Abell, Advances in Amino Acid Mimetics and Peptidomimetics, JAI Press Inc., Greenwich, CT (2006).
Aplin et al., Preparation, Properties, and Applications of Carbohydrate Conjugates of Proteins and Lipids, CRC Crit. Rev. Biocehem. (1981).
Arai et al., Design of the linkers which effectively separate domains of a bifunctional fusion protein, *Protein Eng.* 14:529-32 (2001).
Arora, Cell Culture Media: A Review, *Mater Methods.* 3:175 (2013).
Atwell et al., Stable heterodimers from remodeling the domain interface of a homodimer using a phage display library, *J. Mol. Biol.* 270:26-35 (1997).
Ausubel et al., Current Protocols in Molecular Biology, John Wiley & Sons (1994).
Banker et al., Pharmaceutics and Pharmacy Practice, J.B. Lippincott Company, Philadelphia, PA (1982).
Bercovici et al., New methods for assessing T-cell responses, *Clin. Diagn. Lab. Immunol.* 7:859-64 (2000).
Bhatt et al., Anti-CD20-interleukin-21 fusokine targets malignant B cells via direct apoptosis and NK-cell-dependent cytotoxicity, *Blood.* 129:2246-56 (2017).
Cassady et al., Herpesvirus vectors for therapy of brain tumors, *Open Virol. J.* 4:103-8 (2010).
Chan et al., Fmoc Solid Phase Peptide Synthesis, Oxford University Press, Oxford, United Kingdom (2005).
Chand et al., A competitive ELISA for detection of group specific antibody to bluetongue virus using anti-core antibody, *Biologicals.* 46:168-171 (2017).
Chen et al., Fusion protein linkers: property, design and functionality, *Adv. Drug Deliv. Rev.* 65:1357-69 (2013).
Chothia et al., Canonical Structures for the hypervariable regions of immunoglobulins, *J. Mol. Biol.* 196:901-17 (1987).
Chothia et al., Conformations of immunoglobulin hypervariable regions, *Nature.* 342:877-83 (1989).
Clay et al., Assays for monitoring cellular immune responses to active immunotherapy of cancer, *Clin. Cancer Res.* 7:1127-35 (2001).
Creighton, Proteins: Structure and Molecular Properties, W.H. Freeman & Co., San Francisco (1983).
Davis et al., Clinical and biological efficacy of recombinant human interleukin-21 in patients with stage IV malignant melanoma without prior treatment: a phase IIa trial, *Clin. Cancer Res.* 15:2123-9 (2009).
Davis et al., SEEDbodies: fusion proteins based on strand-exchange engineered domain (SEED) CH3 heterodimers in an Fc analogue platform for asymmetric binders or immunofusions and bispecific antibodies, *Protein Eng. Des. Sel.* 23:195-202 (2010).
Fessas et al., A molecular and preclinical comparison of the PD-1-targeted T-cell checkpoint inhibitors nivolumab and pembrolizumab, *Seminars in Oncol.* 44:136-40 (2017).
Fowler, Design, Synthesis, and Evaluation of Novel Peptoids, University of Wisconsin Madison (2008).
Frenzel et al., Expression of recombinant antibodies, *Front. Immunol.* 4:217 (2013).
Fu et al., A simple and sensitive method for measuring tumor-specific T cell cytotoxicity, *PLoS One.* 5:e11867 (2010).
Gaillet et al., High-level recombinant protein production in CHO cells using an adenoviral vector and the cumate gene-switch, *Biotechnol. Prog.* 23:200-9 (2007).
Geffer et al., Divergent functions and distinct localization of the Notch ligands DLL1 and DLL3 in vivo, *J. Cell. Biol.* 178:465-76 (2007).
Goolia et al., Validation of a competitive ELISA and a virus neutralization test for the detection and confirmation of antibodies to Senecavirus A in swine sera, *J. Vet. Diagn. Invest.* 29:250-253 (2017).
Green et al., Antigen-specific human monoclonal antibodies from mice engineered with human Ig heavy and light chain YACs, *Nat. Genet.* 7:13-21 (1994).
Green et al., Regulation of B cell development by variable gene complexity in mice reconstituted with human immunoglobulin yeast artificial chromosomes, *J. Exp. Med.* 188:483-95 (1998).
Gunasekaran et al., Enhancing antibody Fc heterodimer formation through electrostatic steering effects: applications to bispecific molecules and monovalent IgG, *J. Biol. Chem.* 285:19637-46 (2010).
Harlow et al., Antobodies: A Laboratory Manual, CSH Press (1988).
Haskard et al., The production of human monoclonal autoantibodies from patients with rheumatoid arthritis by the EBV-hybridoma technique, *J. Immunol. Methods.* 74:361-7 (1984).
Hermel et al., Combining forces: the promise and peril of synergistic immune checkpoint blockade and targeted therapy in metastatic melanoma, *Cancer Metastasis Rev.* 36:43-50 (2017).
Huse et al., Generation of a large combinatorial library of the immunoglobulin repertoire in phage lambda, *Science.* 246:1275-81 (1989).
Huston et al., Protein engineering of antibody binding sites: recovery of specific activity in an anti-digoxin single-chain Fv analogue produced in *Escherichia coli, Proc. Natl. Acad. USA.* 85:5879-83 (1988).
Imai-Nishiya et al., Double knockdown of alpha1,6-fucosyltransferase (FUT8) and GDP-mannose 4,6-dehydratase (GMD) in antibody-producing cells: a new strategy for generating fully non-fucosylated therapeutic antibodies with enhanced ADCC, *BMC Biotechnol.* 7:84 (2007).
International Search Report and Written Opinion, PCT/US2018/045105 (dated Jan. 16, 2019).
Jacobsen et al., Engineering an IgG Scaffold Lacking Effector Function with Optimized Developability, *J. Biol. Chem.* 292:1865-75 (2017).
Jameel et al., Formulation and Process Development Strategies for Manufacturing, John Wiley & Sons, Inc., Hoboken, NJ (2010).
Janeway et al., Immunobiology: The Immune System in Health and Disease, Elsevier Science Ltd./Garland Publishing (4th ed. 1999).
Kabat et al., Sequences of Proteins of Immunological Interest, National Institutes of Health (5th ed. 1991).
Kellerman et al., Antibody discovery: the use of transgenic mice to generate human monoclonal antibodies for therapeutics, *Curr. Opin. Biotechnology.* 13:593-7 (2002).
Khan, Gene expression in Mammalian cells and its applications, *Adv. Pharm. Bull.* 3:257-63 (2013).
Kibbe, Handbook of Pharmaceutical Excipients, Pharmaceutical Press, London, UK (3rd ed. 2000).
Kohler et al., Continuous cultures of fused cells secreting antibody of predefined specificity, *Nature.* 256:495-7 (1975).
Kontermann, Antibody-Cytokine fusion proteins, *Arch. Biochem. Biophys.* 526:194-205 (2012).
Kontermann et al., Antibody Engineering, Springer (2010).
Kufer et al., A revival of bispecific antibodies, *Trends Biotechnol.* 22:238-44 (2004).
Labrijn et al., Efficient generation of stable bispecific IgG1 by controlled Fab-arm exchange, *Proc. Natl. Acad. Sci. USA.* 110:5145-50 (2013).
Lewis et al., Interleukin-21 combined with PD-1 or CTLA-4 blockade enhances antitumor immunity in mouse tumor models, *Oncoimmunology.* 4:e1377873 (2017).

(56) References Cited

OTHER PUBLICATIONS

Li et al., Cell culture processes for monoclonal antibody production, *MAbs.* 2:466-479 (2010).
Liu et al., Biological Characterization of a Stable Effector Functionless (SEFL) Monoclonal Antibody Scaffold in Vitro, *J. Biol. Chem.* 292:1876-83 (2017).
Liu et al., Development of competitive ELISA for the detection of bovine serum albumin using single-chain variable fragments, *Anal. Biochem.* 525:89-91 (2017).
Liu et al., ICP34.5 deleted herpes simplex virus with enhanced oncolytic, immune stimulating, and anti-tumour properties, *Gene Ther.* 10:292-303 (2003).
Macatangay et al., Comparison of immunologic assays for detecting immune responses in HIV immunotherapeutic studies: AIDS Clinical Trials Group Trial A5181, *Clin. Vaccine Immunol.* 17:1452-9 (2010).
Meignier et al., In vivo behavior of genetically engineered herpes simplex viruses R7017 and R7020: construction and evaluation in rodents, *J. Infect. Dis.* 158:602-14 (1988).
Mendez et al., Functional transplant of megabase human immunoglobulin loci recapitulates human antibody response in mice, *Nat. Genet.* 15:146-56 (1997).
Mooradian et al., A phase II study of combined therapy with a BRAF inhibitor (vemurafenib) and interleukin-2 (aldesleukin) in patients with metastatic melanoma, *Oncoimmunology.* 7:e1423172 (2018).
Moore et al., A novel bispecific antibody format enables simultaneous bivalent and monovalent co-engagement of distinct target antigens, *MAbs.* 3:546-57 (2011).
Notification of Decision on Protest or Declaration that Protest Considered not to Have Been Made, PCT/US2018/045105 (Jan. 16, 2019).
Orlandi et al., Cloning immunoglobulin variable domains for expression by the polymerase chain reaction, *Proc. Natl. Acad. Sci. USA.* 86:3833-7 (1989).
Osol, Remington's Pharmaceutical Sciences, Mack Publishing Co., Easton, PA. (16th ed. 1980).
Ott et al., Combination immunotherapy: a road map, *J. Immunother. Cancer.* 5:16 (2017).
Padlan, Anatomy of the antibody molecule, *Mol. Immunol.* 31:169-217 (1994).
Portielje et al., Repeated administrations of interleukin (IL)-12 are associated with persistently elevated plasma levels of IL-10 and declining IFN-gamma, tumor necrosis factor-alpha, IL-6, and IL-8 responses, *Clin. Cancer Res.* 9:76-83 (2003).
Qian et al., Sustained release subcutaneous delivery of BMS-686117, a GLP-1 receptor peptide agonist, via a zinc adduct, *Int. J. Pharm.* 374:46-52 (2009).
Reid, Peptide Drug Analysis, Marcel Dekker, Inc. (2000).
Ridgway et al., 'Knobs-into-holes' engineering of antibody CH3 domains for heavy chain heterodimerization, *Protein Eng.* 9:617-21 (1996).
Roder et al., "The EBV-hybridoma technique," *Methods Enzymol.* 121:140-67 (1986).
Sambrook et al., Molecular Cloning, Cold Spring Harbor Laboratory Press (2nd ed. 1989).
Seebach et al., Beta-Peptides:Synthesis by Arndt-Eistert Homologation with concomitant peptide coupling. Structure Detemination by NMR and CD Spectroscopy and by X-Ray crystallography. Helical secondary structure of Beta-Hexapeptide in solution and its stability towards pepsin, *Helvetica Chimica Acta.* 79:913-41 (1996).
Shimamoto et al., Peptibodies: A flexible alternative format to antibodies, *MAbs.* 4:586-91 (2012).
Spiess et al., Alternative molecular formats and therapeutic applications for bispecific antibodies, *Molecular Immunology.* 67:95-106 (2015).
Spiess et al., Alternative molecular formats and therapeutic applications for bispecific antibodies, *Mol. Immunol.* 67:95-106 (2015).
Spolski et al., Interleukin-21: a double-edged sword with therapeutic potential, *Nat. Rev. Drug Discov.* 13:379-95 (2014).
Strop et al., Generating bispecific human IgG1 and IgG2 antibodies from any antibody pair, *J. Mol. Biol.* 420:204-19 (2012).
Structural Genomics Consortium et al., Protein production and purification, *Nat. Methods.* 5:135-46 (2008).
Thompson et al., DNA sequence and RNA transcription through a site of recombination in a non-neurovirulent herpes simplex virus intertypic recombinant, *Virus Genes.* 1:275-86 (1988).
Thompson et al., Phase I study of recombinant interleukin-21 in patients with metastatic melanoma and renal cell carcinoma, *J. Clin. Oncol.* 26:2034-9 (2008).
Toissel, ASHP Handbook on Injectable Drugs (4th ed. 1986).
Varghese et al., Oncolytic herpes simplex virus vectors for cancer virotherapy, *Cancer Gene Ther.* 9:967-78 (2002).
Von Kreudenstein et al., Improving biophysical properties of a bispecific antibody scaffold to aid developability: quality by molecular design, *MAbs.* 5:646-54 (2013).
Wan et al., The cytokines IL-21 and GM-CSF have opposing regulatory roles in the apoptosis of conventional dendritic cells, *Immunity.* 38:514-27 (2013).
Westwood et al., Epitope Mapping, Oxford University Press, Oxford, United Kingdom (2000).
Winter et al., Man-made antibodies, *Nature.* 349:293-9 (1991).
Wriggers et al., Control of protein functional dynamics by peptide linkers, *Biopolymers.* 80:736-46 (2005).
Zhang et al., Interleukin-10:An Immune-Activating Cytokine in Cancer Immunotherapy, *J Clin. Oncol.* 34:3576-8 (2016).
Zuckermann et al., Efficient Method for the preparation of peptoids [Oligo(N-substituted glycines)] by submonomer solid-phase synthesis, *J. Am. Chem. Soc.* 10646-7 (1992).
Davis et al., "SEEDbodies: fusion proteins based on strand-exchange engineered domain (SEED) $C_H3$ heterodimers in an Fc analogue platform for asymmetric binders or immunofusions and bispecific antibodies," *Protein Engineering, Design & Selection* 23(4): 195-202 (2010).
Jazayeri and Carroll, "Fc-Based Cytokines: Prospects for Engineering Superior Therapeutics," *Biodrugs* 22(1): 11-26 (2008).
Hamming et al., "Crystal Structure of Interleukin-21 Receptor (IL-21R) Bound to IL-21 Reveals That Sugar Chain Interacting with WSXWS Motif Is Integral Part of IL-21R," *Journal of Biological Chemistry* 287(12): 9454-9460 (2012).
Helguera et al., "Cytokines fused to antibodies and their combinations as therapeutic agents against different peritoneal HER2/neu expressing tumors," *Molecular Cancer Therapeutics* 5(4): 1029-1040(2006).
Ortiz-Sánchez et al., "Antibody-cytokine fusion proteins: applications in cancer therapy," *Expert Opinion on Biological Therapy* 8(5): 609-632 (2008).
Jure-Kunkel et al., "Nonclinical evaluation of the combination of mouse IL-21 and anti-mouse CTLA-4 or PD-1 blocking antibodies in mouse tumor models," *Journal of Clinical Oncology* 31(15): 1-3 (2013).

* cited by examiner

Iso vs IL-21, p=ns, 0.1269
Iso vs αPD-1 mAb, p=0.0408
Iso combo, p=0.0002
αPD-1 mAb vs. combo, p=0.0143
IL-21 vs. combo, p=0.0047 pSTAT3 alphaliza Hut78 T cells: PD-1$^{-ve}$ pSTAT3 alphaliza Hut78 T cells: PD-1$^{+ve}$

* Solid line represents fusion without linker and dotted line represents fusion with linker Muteins designed to have reduced binding to IL-21Rcγ
3.7nM Fusion protein / rhIL-21

PD1-ve

PD1+ve

Anti-PD-1 mAb-IL-21 mutein fusion proteins exhibited altered distribution compared to parent anti-PD-1 mAb Solid line = Fusion protein comprising anti-PD-1 mAb fused to IL-21 R5E:R76A double mutein Solid line = Fusion protein comprising anti-PD-1 mAb fused to IL-21 R5Q:R76E double mutein Solid line = Fusion protein comprising anti-PD-1 mAb fused to IL-21 R9E:R76A double mutein Double mutein = IL-21 R5E/R76A Double mutein = IL-21 R5Q/R76E Double mutein = IL-21 R9E/R76A PD-1 targeting needed for pSTAT3 signal, activity of mutein similar across different PD-1 mAb variants vs PD-1 targeting needed for pSTAT3 signal, activity of mutein similar across different PD-1 mAb variants

R9E, R76A HUT78 vs

R9E, R76A HUT78-PD1 pSTAT3 PD-1(-)

pSTAT3 PD-1(+)

pSTAT3 PD-1(-)
n1
Alpha Signal (Counts)
Ab concentration log(nM)

n2
Alpha Signal (Counts)
Ab concentration log(nM)

pSTAT3 PD-1(+)
Alpha Signal (Counts)
Ab concentration log(nM)

n2
Alpha Signal (Counts)
Ab concentration log(nM)

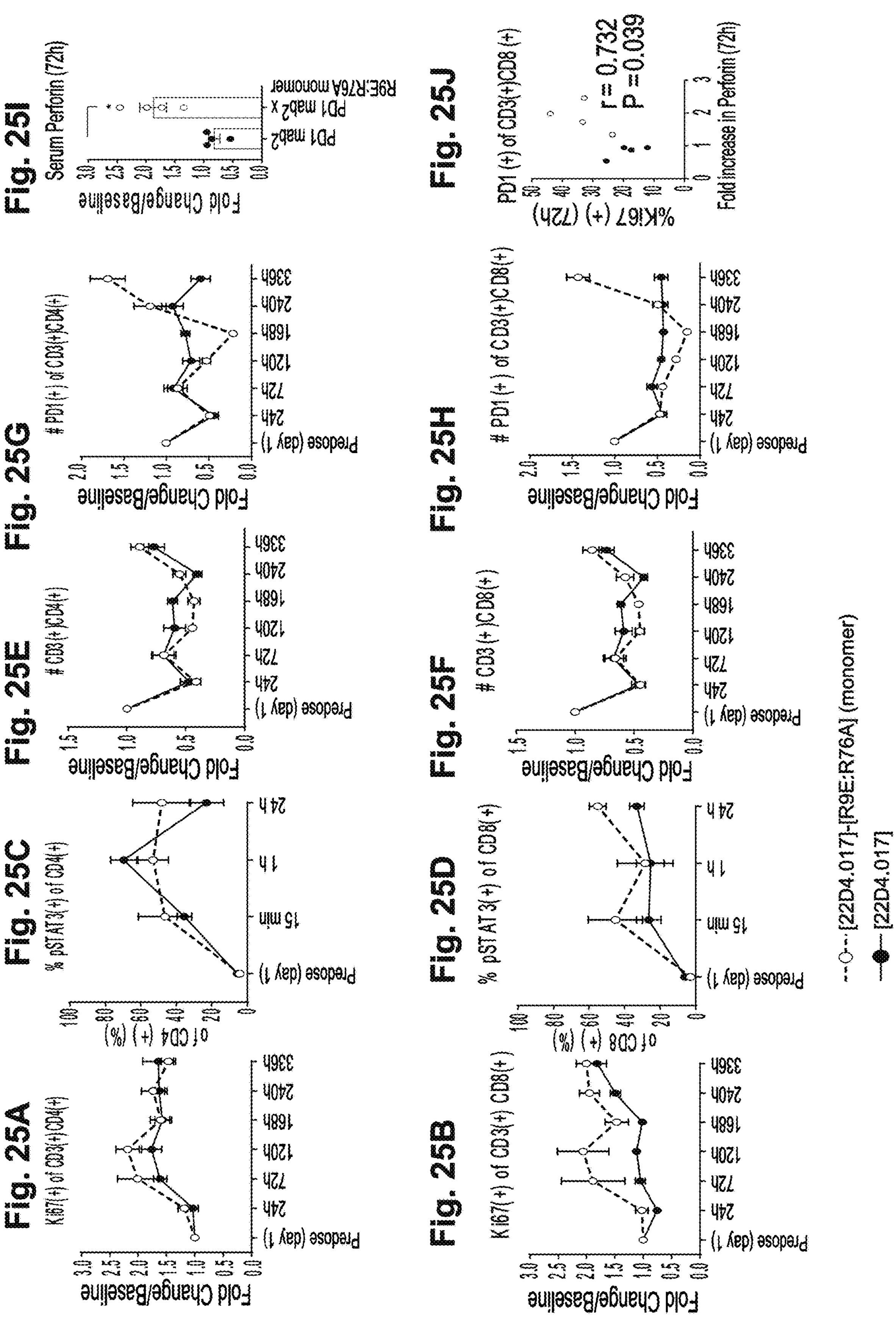
Fig. 25A
Ki67(+) of CD3(+)CD4(+)
Fold Change/Baseline
Predose (day 1) 24h 72h 120h 168h 240h 336h
Fig. 25C
% pSTAT3(+) of CD4(+)
of CD4 (+) (%)
Predose (day 1) 15 min 1 h 24 h
Fig. 25E
CD3(+)CD4(+)
Fold Change/Baseline
Fig. 25G
PD1(+) of CD3(+)CD4(+)
Fold Change/Baseline
Fig. 25I
Serum Perforin (72h)
Fold Change/Baseline
PD1 mab2
PD1 mab2 x R9E:R76A monomer
Fig. 25B
Ki67(+) of CD3(+) CD8(+)
Fold Change/Baseline
Fig. 25D
% pSTAT3(+) of CD8(+)
of CD8 (+) (%)
Fig. 25F
CD3(+)CD8(+)
Fold Change/Baseline
Fig. 25H
PD1(+) of CD3(+)CD8(+)
Fold Change/Baseline
Fig. 25J
PD1 (+) of CD3(+)CD8 (+)
%Ki67 (+) (72h)
r = 0.732
P = 0.039
Fold increase in Perforin (72h)
[22D4.017]-[R9E:R76A] (monomer)
[22D4.017]

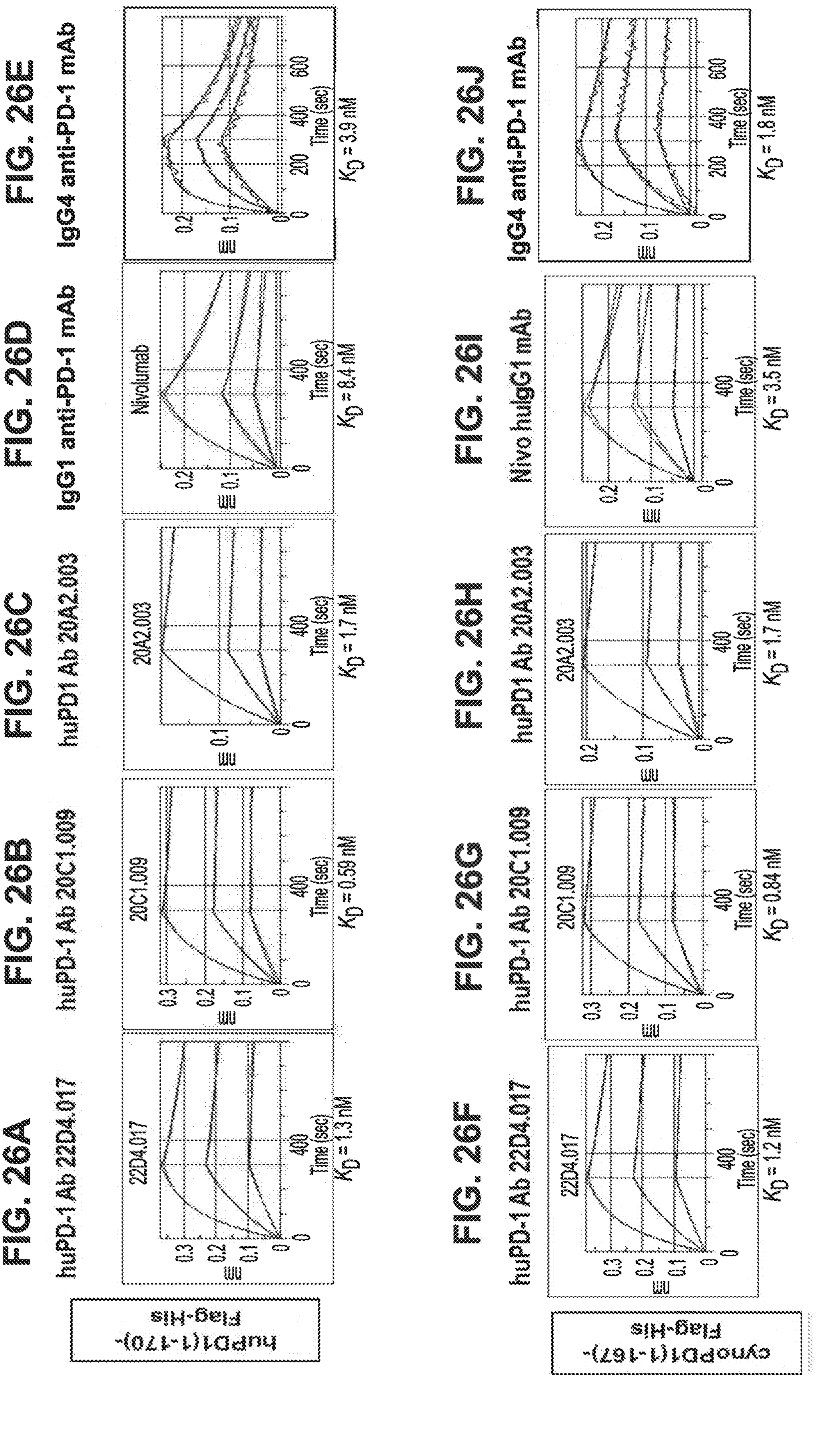
FIG. 26A huPD-1 Ab 22D4.017
FIG. 26B huPD-1 Ab 20C1.009
FIG. 26C huPD1 Ab 20A2.003
FIG. 26D IgG1 anti-PD-1 mAb
FIG. 26E IgG4 anti-PD-1 mAb
FIG. 26F huPD-1 Ab 22D4.017
FIG. 26G huPD-1 Ab 20C1.009
FIG. 26H huPD1 Ab 20A2.003
FIG. 26I Nivo huIgG1 mAb
FIG. 26J IgG4 anti-PD-1 mAb Hut78

Hut78/PD1

Hut78/TIGIT

Hut78/LAG3
rhIL-21
PD1 x IL-21 R5Q:R76E
TIGIT x IL-21 R5Q:R76E
LAG3 x IL-21 R5Q:R76E
Alpha Signal (counts)
Ab Concentration (nM)
0.00001 0.0001 0.001 0.01 0.1 1 10 100 1000 10000
huIgG1
rhIL-21
22D4 017
TIGIT mAb
LAG3 mAb
PD1 mab x R5Q:R76E
TIGIT mab x R5Q:R78E
LAG3 mab x R5Q:R78E
Engineered Hut78 T cell lines expressing either PD-1, TIGIT or LAG3

ANTI-PD-1 ANTIBODIES AND METHODS OF TREATMENT

CROSS-REFERENCE TO RELATED APPLICATIONS

This application claims priority to U.S. Provisional Application No. 62/616,733, filed on Jan. 12, 2018, and U.S. Provisional Application No. 62/770,029, filed on Nov. 20, 2018. The contents of each application are incorporated herein by reference.

INCORPORATION BY REFERENCE OF MATERIAL SUBMITTED ELECTRONICALLY

Incorporated by reference in its entirety is a computer-readable nucleotide/amino acid sequence listing submitted concurrently herewith and identified as follows: 1,429,100 byte ASCII (Text) file named "53810_Seqlisting.txt"; created on Jan. 10, 2019.

BACKGROUND

The PD-1/PD-L1 axis is involved in the suppression of T cell immune responses in cancer. Antagonists of this pathway have been clinically validated across a number of solid tumor indications. Nivolumab and pembrolizumab are two such inhibitors that target the PD-1 pathway, and each has been approved by the U.S. Food and Drug Administration (FDA) for the treatment of metastatic melanoma. Recently, researchers have tested the paradigm of checkpoint inhibition in the setting of other tumor types. While some advances have been made, checkpoint inhibition therapy still remains in the shadows of other cancer treatment options.

Studies of checkpoint inhibitors in combination with other agents are underway or recently have been completed. The combination of nivolumab and ipilimumab, a CTLA-4 receptor blocking antibody, for example, was tested in a Phase III clinical trial on patients with unresectable stage III or IV melanoma. In this study, the percentage of patients achieving a complete response was the highest among those that received the combination of nivolumab and ipilimumab, beating the outcome exhibited by those in the group receiving either drug alone. Other combinations are also currently being explored.

Interleukin-21 (IL-21) is a T cell derived pleiotropic cytokine that regulates the activity of both innate and adaptive immune cells. IL-21 can augment T cell survival and effector function. Because it plays a key role in anti-tumor and anti-viral responses, in addition to exerting major effects on inflammatory responses that lead to the development of autoimmune diseases and inflammatory diseases, IL-21 has been an attractive target for several therapies.

However, the development of IL-21-based therapies has been complex. The research has been complicated by studies showing that enhancing, or confusingly, inhibiting IL-21 action leads to a therapeutic effect. Additional challenges exist due to the broad expression of the receptor for IL-21 (IL-21R). IL-21R is expressed not just on T cells, but also on B cells, NK cells and myeloid cells. Accordingly, care must be taken to limit broad IL-21 activation in leukocytes and avoid the potential for toxicity. Restriction of IL-21 signaling must be balanced and selective. Triggering the effects of IL-21 must be designed to occur at the right time and place.

Indeed, any success, especially clinical success with IL-21 moieties as a monotherapy or in combination with checkpoint inhibitors, has been muted. Thus, there remains a need for treatment modalities utilizing IL-21, including modalities combining IL-21 moieties with checkpoint inhibitors.

There also remains a need for IL-21 therapies combined with immune checkpoint inhibition.

SUMMARY

The present disclosure provides IL-21 muteins comprising the amino acid sequence of SEQ ID NO: 2, wherein SEQ ID NO: 2 is QGQDX HMXXM XXXXX XVDXL KNXVN DLVPE FLPAP EDVET NCEWS AFSCF QKAQL KSANT GNNEX XIXXX XXXLX XXXXX TNAGR RQKHR LTCPS CDSYE KKPPK EFLXX FXXLL XXMXX QHXSS RTHGS EDS (SEQ ID NO: 2), and X is any amino acid, and wherein the IL-21 mutein amino acid sequence differs from the amino acid sequence of human IL-21 (SEQ ID NO: 1) by at least 1 amino acid.

Thus, in one aspect, the present disclosure also provides IL-21 muteins comprising only one amino acid substitution, relative to the wild-type IL-21 amino acid sequence, which is provided herein as SEQ ID NO: 1. In exemplary aspects, the amino acid substitution is located at an amino acid position selected from the group consisting of: 5, 8, 9, 11, 12, 13, 14, 15, 16, 19, 23, 65, 66, 68, 69, 70, 72, 73, 75, 76, 77, 78, 79, 80, 109, 110, 112, 113, 116, 117, 119, 120, or 123, according to the amino acid position numbering of SEQ ID NO: 1.

The present disclosure further provides IL-21 muteins comprising only two amino acid substitutions, relative to SEQ ID NO: 1. In exemplary aspects, the amino acid substitutions are located at two amino acid positions selected from the group consisting of: 5, 9, 15, 70, 71, 72, 73, and 76, according to the amino acid position numbering of SEQ ID NO: 1.

In exemplary embodiments, the IL-21 muteins bind to the IL-21 receptor (IL-21R) with a reduced affinity, relative to the affinity of wild-type IL-21 for the IL-21 receptor. In exemplary aspects, the IL-21 mutein binds to the human IL-21R with a $K_D$ that is greater than or is about 0.04 nM. In exemplary aspects, the IL-21 mutein bind to the cynomolgus monkey IL-21R with a $K_D$ that is greater than or is about 0.055 nM.

The present disclosure also provides conjugates comprising an IL-21 mutein of the present disclosure linked to a heterologous moiety. In exemplary aspects, the heterologous moiety is a polypeptide, such that the conjugate is a fusion protein. Therefore, the present disclosure provides fusion proteins comprising an IL-21 mutein of the present disclosure. In exemplary aspects, the fusion protein comprises an IL-21 mutein of the present disclosure linked to an antigen-binding protein, such as an antibody, or an antigen binding antibody fragment thereof.

In particular embodiments, the fusion protein comprises an IL-21 mutein linked to a PD-1 antigen-binding protein (e.g., a PD-1 antigen-binding antibody) of the present disclosure.

The present disclosure also provides PD-1 antigen-binding proteins and conjugates and fusion proteins comprising a PD-1 antigen-binding protein.

The present disclosure further provides nucleic acids comprising a nucleotide sequence encoding an IL-21 mutein, a PD-1 antigen-binding protein (e.g., a PD-1 antigen-binding antibody), or a fusion protein comprising an IL-21 mutein and a PD-1 antigen-binding protein (e.g., a PD-1 antigen-binding antibody) of the present disclosure. In exemplary aspects, the nucleic acid molecule comprises a nucleotide sequence encoding a conjugate or fusion protein of the present disclosure. Vectors comprising the nucleic acids of the present disclosure and host cells comprising the nucleic acids of the present disclosure are furthermore provided herein.

The present disclosure additionally provides kits comprising an IL-21 mutein, a PD-1 antigen-binding protein (e.g., a PD-1 antigen-binding antibody), a conjugate, fusion protein (e.g., a fusion protein comprising an IL-21 mutein and a PD-1 antigen-binding protein (e.g., a PD-1 antigen-binding antibody)), nucleic acid, vector, or host cell of the present disclosure, or a combination thereof.

Pharmaceutical compositions comprising an IL-21 mutein, a PD-1 antigen-binding protein (e.g., a PD-1 antigen-binding antibody), a conjugate, fusion protein (e.g., a fusion protein comprising an IL-21 mutein and a PD-1 antigen-binding protein (e.g., a PD-1 antigen-binding antibody)), nucleic acid, vector, or host cell of the present disclosure, or a combination thereof, are provided herein.

Methods of making an IL-21 mutein, PD-1 antigen-binding protein (e.g., a PD-1 antigen-binding antibody), and a fusion protein comprising an IL-21 mutein and a PD-1 antigen-binding protein (e.g., a PD-1 antigen-binding antibody) are provided herein. The method, in exemplary embodiments, comprises culturing a host cell of the present disclosure to express the IL-21 mutein, PD-1 antigen-binding protein (e.g., a PD-1 antigen-binding antibody), or a fusion protein comprising an IL-21 mutein and a PD-1 antigen-binding protein (e.g., a PD-1 antigen-binding antibody) and harvesting the expressed IL-21 mutein, PD-1 antigen-binding protein (e.g., a PD-1 antigen-binding antibody), or fusion protein comprising an IL-21 mutein and a PD-1 antigen-binding protein (e.g., a PD-1 antigen-binding antibody).

Methods of treatment are additionally provided by the present disclosure. The method, in exemplary embodiments, is a method of treating a subject in need thereof, comprising administering to the subject in need thereof a pharmaceutical composition of the present disclosure in an amount effective to treat the subject. In exemplary aspects, the subject has a tumor (e.g., a solid tumor, a hematological malignancy, or a lymphoid malignancy) and the pharmaceutical composition is administered to the subject in an amount effective to treat the tumor in the subject. In other exemplary aspects, the tumor is non-small cell lung cancer (NSCLC) (e.g., Stage III or IV NSCLC), small cell lung cancer (SCLC), head and neck cancer, renal cancer, breast cancer, melanoma, ovarian cancer, liver cancer, pancreatic cancer, colon cancer, prostate cancer, gastric cancer, bladder cancer, hepatocellular carcinoma, cancers with high microsatellite instability (i.e., MSI-high cancers), lymphoma or leukemia.

anti-PD-1 mAb alone (solid line with closed diamonds), (iii) anti-PD-1 mAb fused to an IL-21 homodimer without linker (solid line with closed triangles), (iv) anti-PD-1 mAb fused to an IL-21 homodimer with a linker (dashed line with open triangles), (v) anti-PD-1 mAb fused to an IL-21 monomer without a linker (solid line with closed squares), or (vi) anti-PD-1 mAb fused to an IL-21 monomer with a linker (dashed line with open squares).

Figure 6:
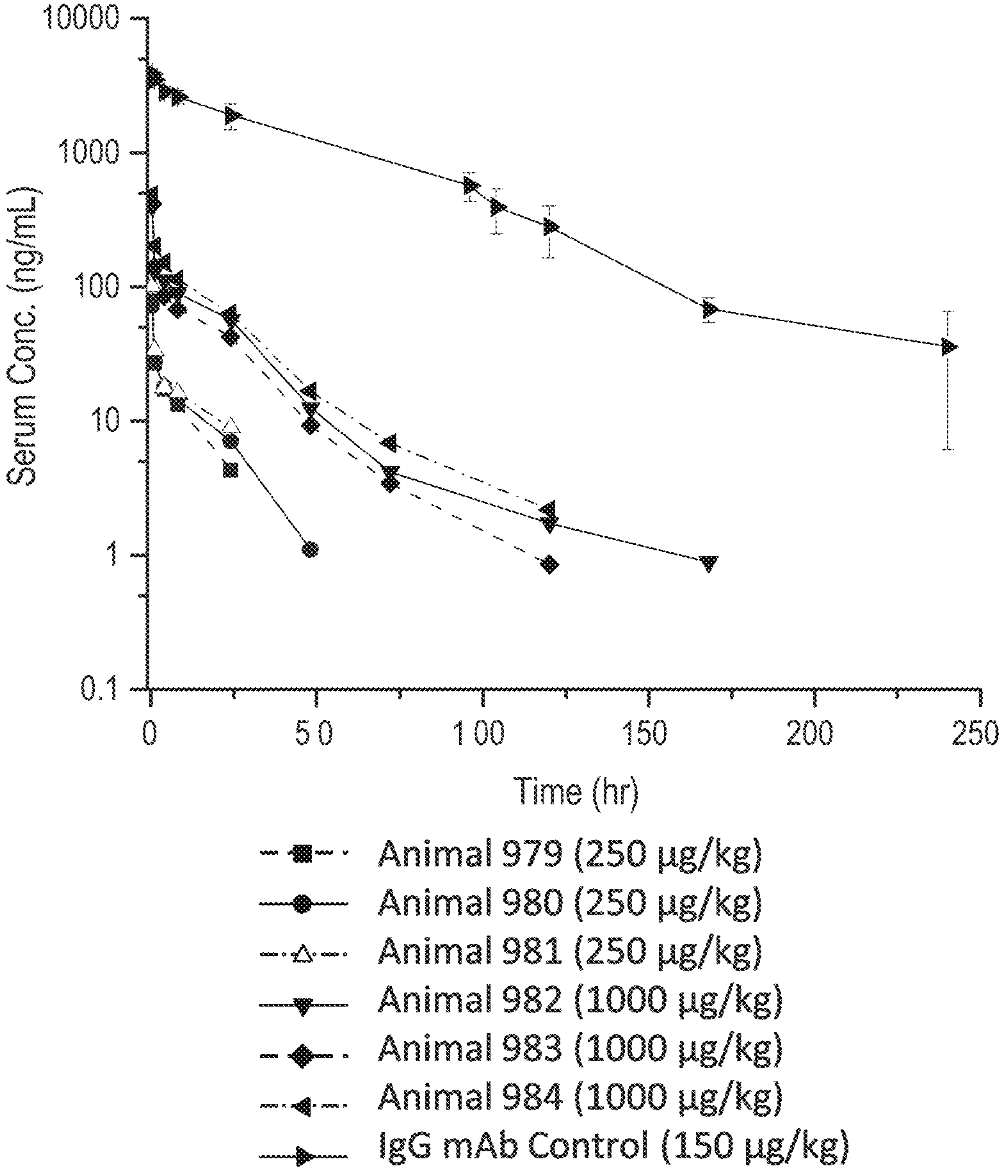

FIG. 6 represents a graph of the serum concentrations of a homodimer fusion protein comprising WT IL-21 fused to an anti-PD-1 mAb that was intravenously administered to 6 animals at either a low dose (250 μg/kg) or a high dose (1000 μg/kg). An IgG antibody domain (150 μg/kg) was run as a control.

Figure 7:
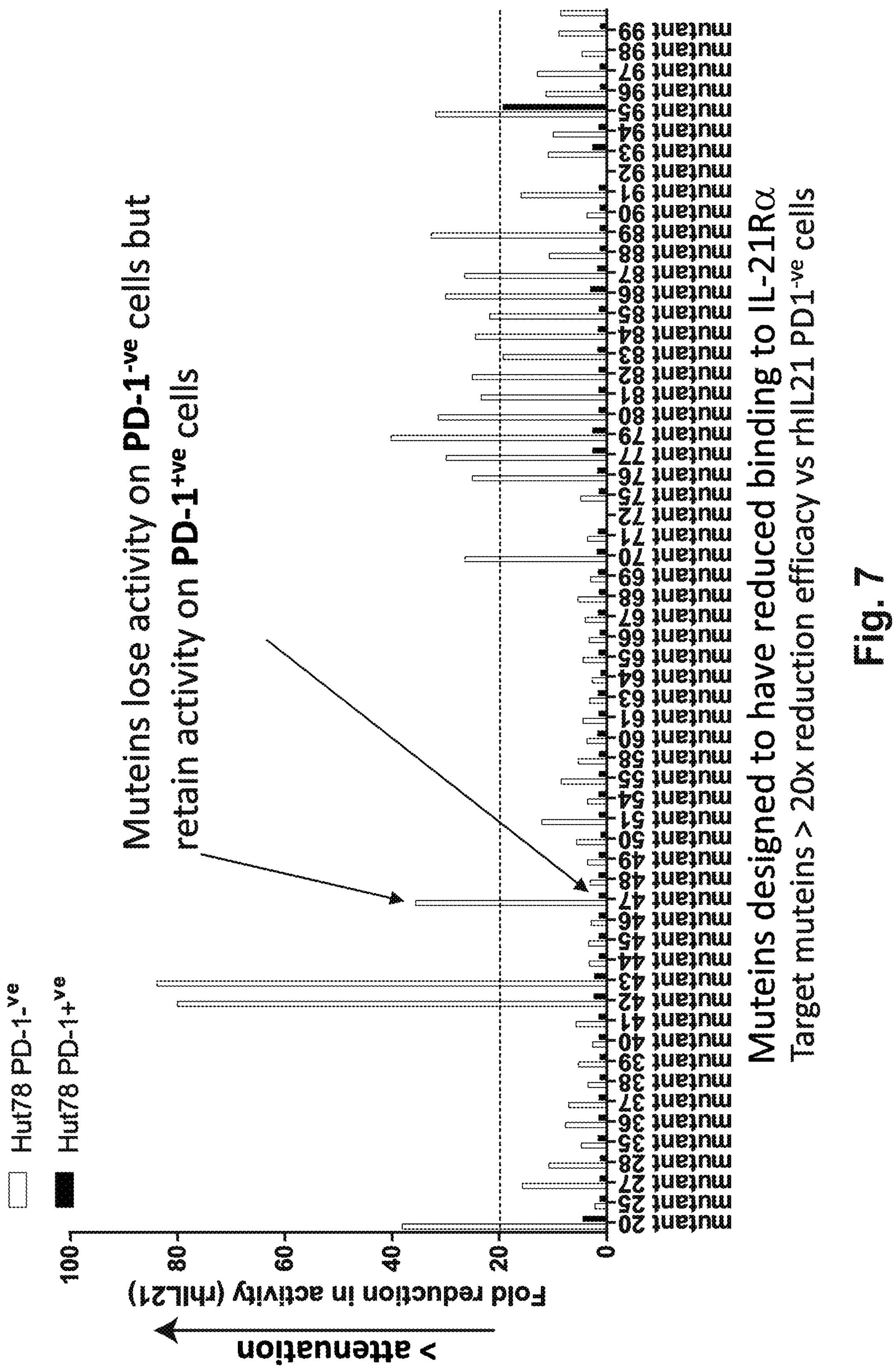

FIG. 7 represents a graph of the fold reduction in IL-21 activity (relative to rhIL-21 activity) by PD-$1^{-ve}$ Hut78 cells (open bars) or PD-$1^{+ve}$ Hut78 cells (closed bars) exposed to IL-21 muteins with reduced affinity for IL-21Rα.

Figure 8:
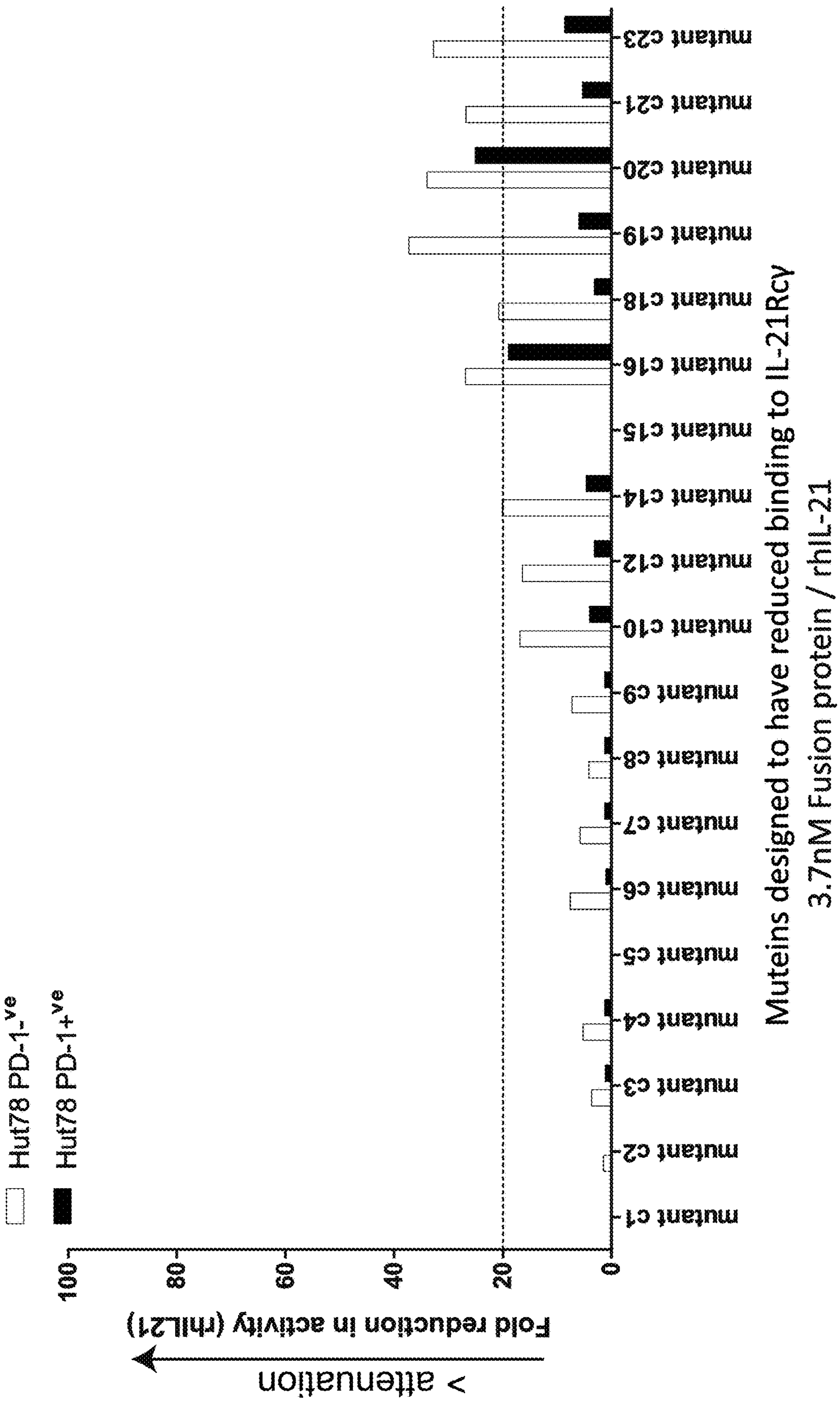

FIG. 8 represents a graph of the fold reduction in IL-21 activity (relative to rhIL-21 activity) by PD-$1^{-ve}$ Hut78 cells (open bars) or PD-$1^{+ve}$ Hut78 cells (closed bars) exposed to IL-21 muteins with reduced affinity for IL-21Rγ.

Figures 9A, 9B:
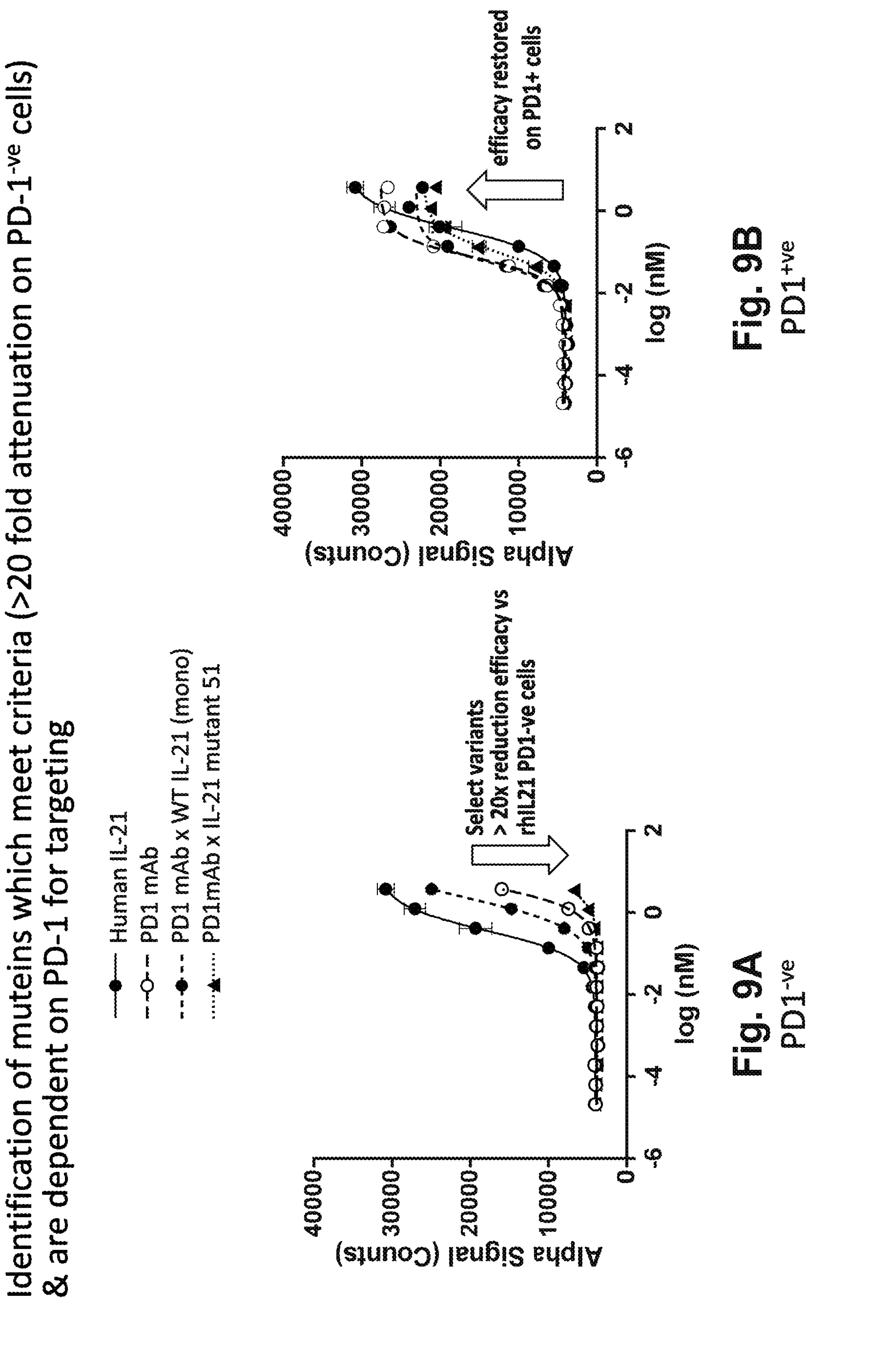

FIG. 9A represents a graph of the STAT3 signaling in PD-$1^{-ve}$ Hut78 T cells exposed to (i) recombinant human IL-21 (rhIL-21) alone (solid line with closed circles), (ii) anti-PD-1 mAb fused to a WT IL-21 homodimer (dashed line with open circles), (iii) anti-PD-1 mAb fused to a WT IL-21 monomer (dashed line with closed circles), and (iv) anti-PD-1 mAb fused to an IL-21 mutein 51 homodimer (R65P) (dotted line with closed triangles).

FIG. 9B represents a graph of the STAT3 signaling in PD-$1^{+ve}$ Hut78 T cells exposed to (i) recombinant human IL-21 (rhIL-21) alone (solid line with closed circles), (ii) anti-PD-1 mAb fused to a WT IL-21 homodimer (dashed line with open circles), (iii) anti-PD-1 mAb fused to a WT IL-21 monomer (dashed line with closed circles), and (iv) anti-PD-1 mAb fused to an IL-21 mutein 51 homodimer (R65P) (dotted line with closed triangles).

Figure 10:
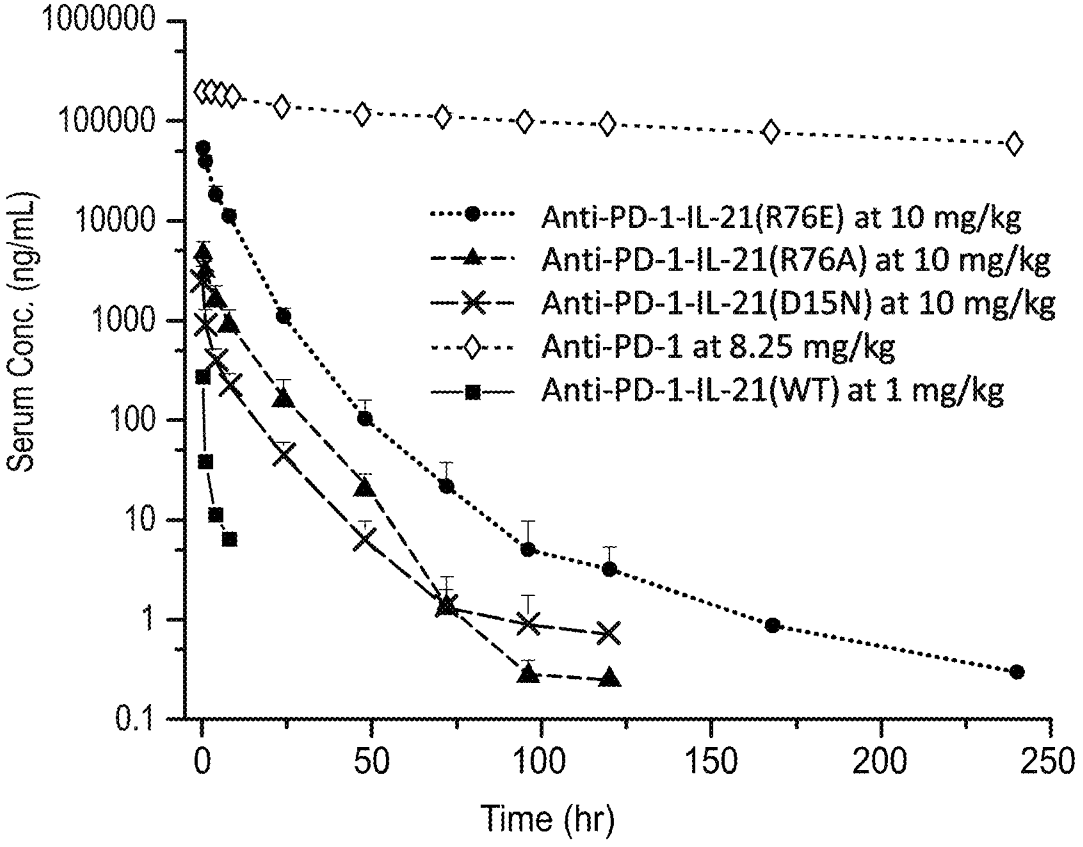

FIG. 10 represents a graph of the serum concentrations of a fusion protein comprising (i) an anti-PD-1 mAb fused to an IL-21 R76E mutein homodimer (dotted line with closed circles), (ii) an anti-PD-1 mAb fused to an IL-21 R76A mutein homodimer (dashed line with closed triangles), (iii) an anti-PD-1 mAb fused to an IL-21 D15N mutein homodimer (dashed line with X's), (iv) an anti-PD-1 antibody (8.25 mg/kg; dashed line with open diamonds), and (v) an anti-PD-1 mAb fused to a WT IL-21 mutein homodimer (solid line with closed squares).

Figure 11:
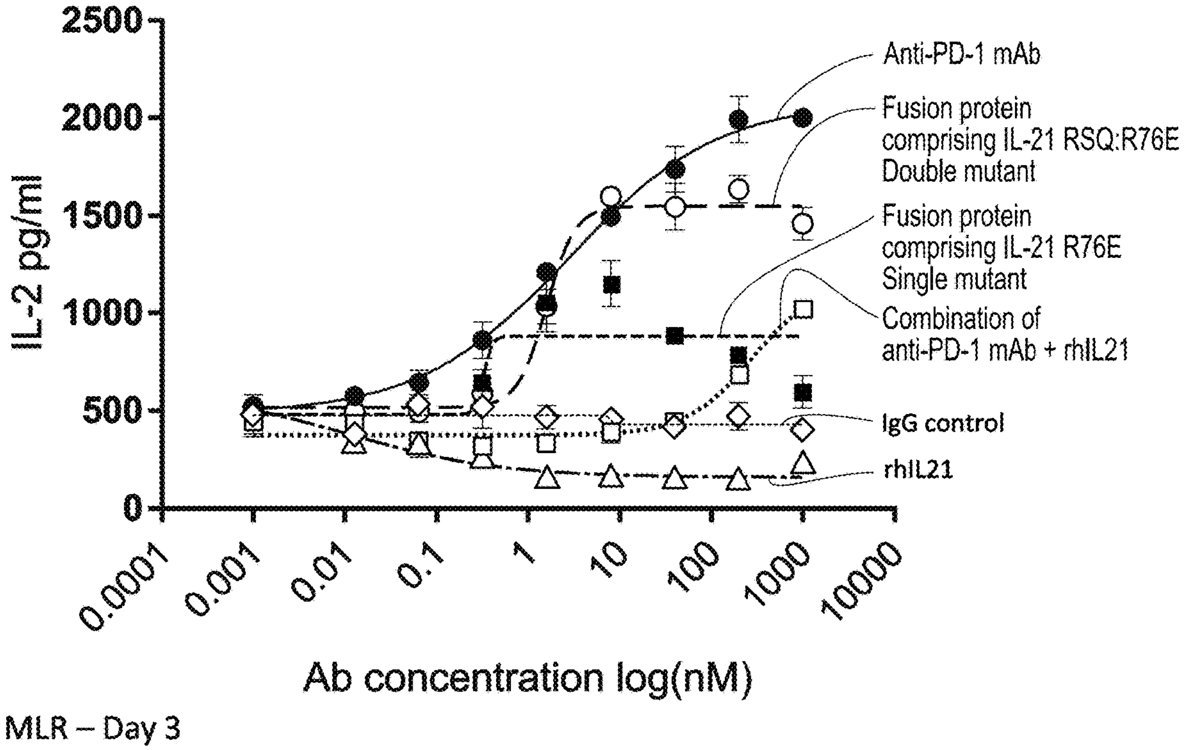

FIG. 11 represents a graph of the IL-2 (pg/mL) secreted by cells of a mixed lymphocyte reaction as a function of antibody concentration of (i) an anti-PD-1 antibody (solid line with closed circles), (ii) a fusion protein comprising IL-21 R5Q/R76E double mutein homodimer (dashed line with open circles), (iii) a combination of anti-PD-1 mAb and rhIL-21 (dotted line with open squares), (iv) a fusion protein comprising IL-21 R76E single mutein homodimer (closed squares), (v) IgG control (dotted line with open diamonds), and (vi) a rhIL-21 (broken line with open triangles).

Figures 12A, 12B, 12C:
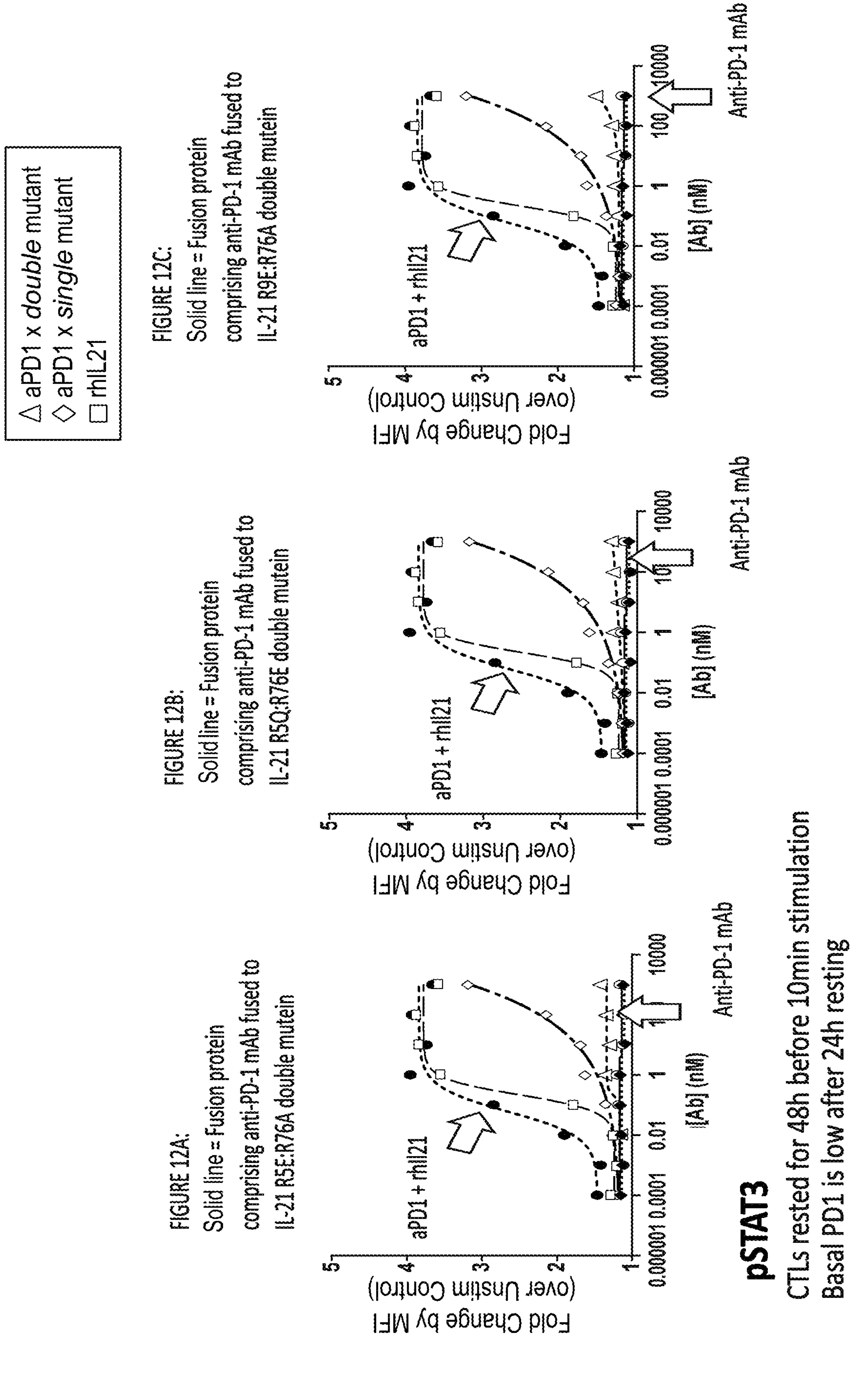

FIG. 12A represents a graph of the fold change of over mean fluorescence intensity (MFI) of STAT3 activity of cells exposed to (i) a fusion protein comprising an IL-21 R5E/R76A double mutein (line with open triangles), (ii) an IgG1 control (dotted line with closed diamonds), (iii) rhIL-21 (dashed line with open squares), (iv) an anti-PD-1 mAb (solid line with open ovals), (v) a combination of rhIL-21 and anti-PD-1 mAb (dashed line with closed ovals), or (vi) a fusion protein comprising an IL-21 R76E single mutein (line with open diamonds).

FIG. 12B represents a graph of the fold change of over MFI of STAT3 activity of cells exposed to (i) a fusion protein comprising an IL-21 R5Q/R76E double mutein (line with open triangles), (ii) an IgG1 control (dotted line with closed diamonds), (iii) rhIL-21 (dashed line with open squares), (iv) an anti-PD-1 mAb (solid line with open ovals), (v) a combination of rhIL-21 and anti-PD-1 mAb (dashed line with closed ovals), or (vi) a fusion protein comprising an IL-21 R76E single mutein (line with open diamonds).

FIG. 12C represents a graph of the fold change of over MFI of STAT3 activity of cells exposed to (i) a fusion protein comprising an IL-21 R9E/R76A double mutein (line with open triangles), (ii) an IgG1 control (dotted line with closed diamonds), (iii) rhIL-21 (dashed line with open squares), (iv) an anti-PD-1 mAb (solid line with open ovals), (v) a combination of rhIL-21 and anti-PD-1 mAb (dashed line with closed ovals), or (vi) a fusion protein comprising an IL-21 R76E single mutein (line with open diamonds).

Figures 13A, 13B, 13C:
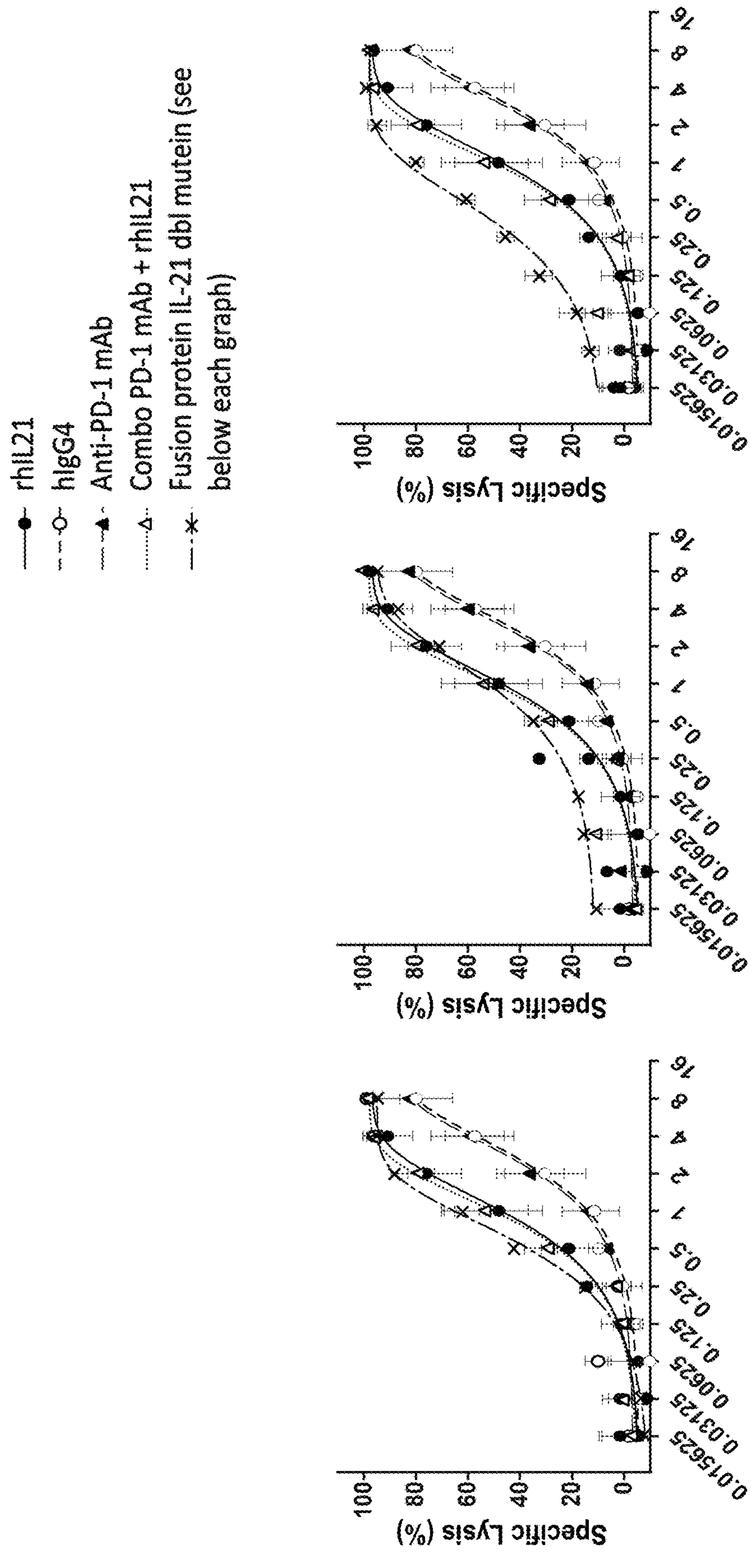

FIG. 13A represents a graph of the % specific lysis by CTLs (y-axis) vs effector to target cell ratios (x-axis) exposed to (i) rhIL-21 (solid line with closed circles), (ii) hIgG4 control antibody (dashed line with open circles), (iii) anti-PD-1 mAb (dashed line with closed triangles), (iv) a combination of rhIL-21 and anti-PD-1 mAb (dotted line with open triangles), or (v) a fusion protein comprising IL-21 R5E/R76A (broken line with X's).

FIG. 13B represents a graph of the % specific lysis by CTLs exposed to represents a graph of the % specific lysis by CTLs exposed to (i) rhIL-21 (solid line with closed circles), (ii) hIgG4 control antibody (dashed line with open circles), (iii) anti-PD-1 mAb (dashed line with closed triangles), (iv) a combination of rhIL-21 and anti-PD-1 mAb (dotted line with open triangles), or (v) a fusion protein comprising IL-21 R5Q/R76E (broken line with X's).

FIG. 13C represents a graph of the % specific lysis by CTLs exposed to (i) rhIL-21 (solid line with closed circles), (ii) hIgG4 control antibody (dahsed line with open circles), (iii) anti-PD-1 mAb (dashed line with closed triangles), (iv) a combination of rhIL-21 and anti-PD-1 mAb (dotted line with open triangles), or (v) a fusion protein comprising IL-21 R9E/R76A (broken line with X's).

Figure 14:
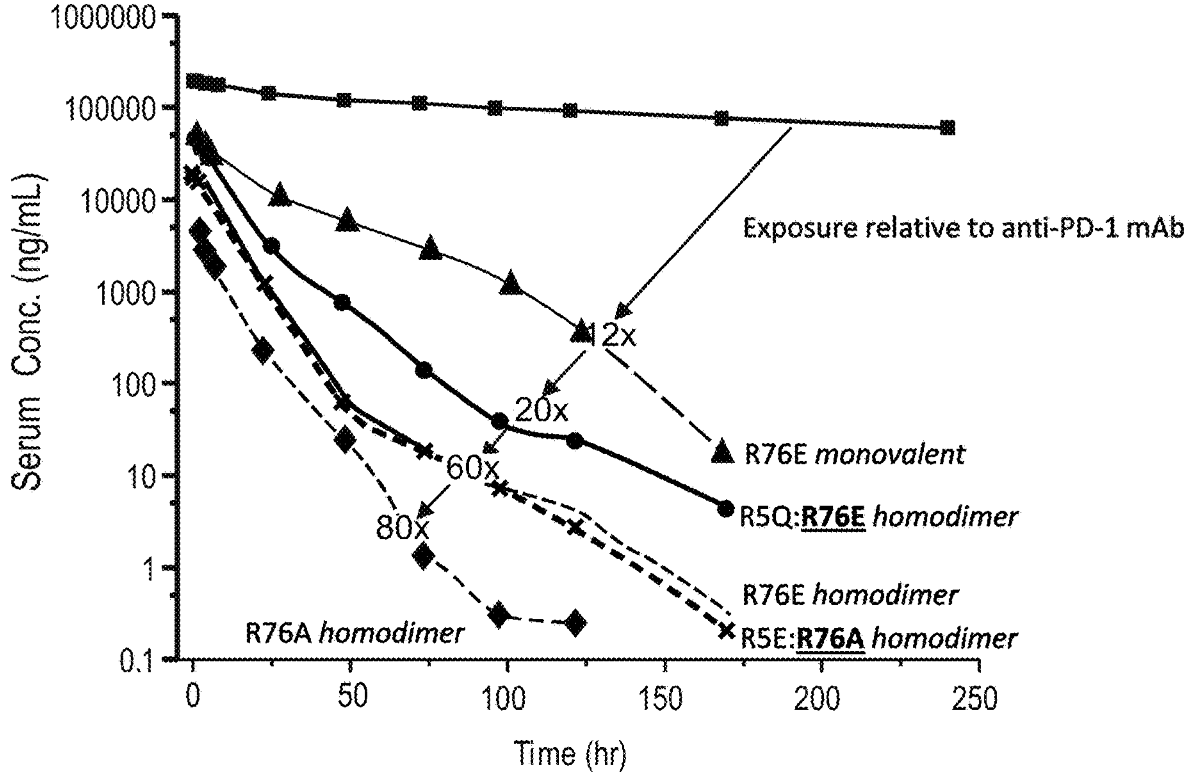

FIG. 14 represents serum concentrations of (i) anti-PD-1 mAb (solid line with closed squares), (ii) a fusion protein comprising anti-PD-1 mAb and an IL-21 R5Q/R76E homodimer (solid line with closed circles), (iii) a fusion protein comprising anti-PD-1 mAb and an IL-21 R76E homodimer (solid line), (iv) a fusion protein comprising anti-PD-1 mAb and an IL-21 R5E/R76A homodimer (dashed line with X's), (v) a fusion protein comprising anti-PD-1 mAb and an IL-21 R76A homodimer (dashed line with closed diamonds), or (vi) a fusion protein comprising anti-PD-1 mAb and an IL-21 R76E monomer (solid line with closed triangles).

Figures 15A, 15B, 15C, 15D:
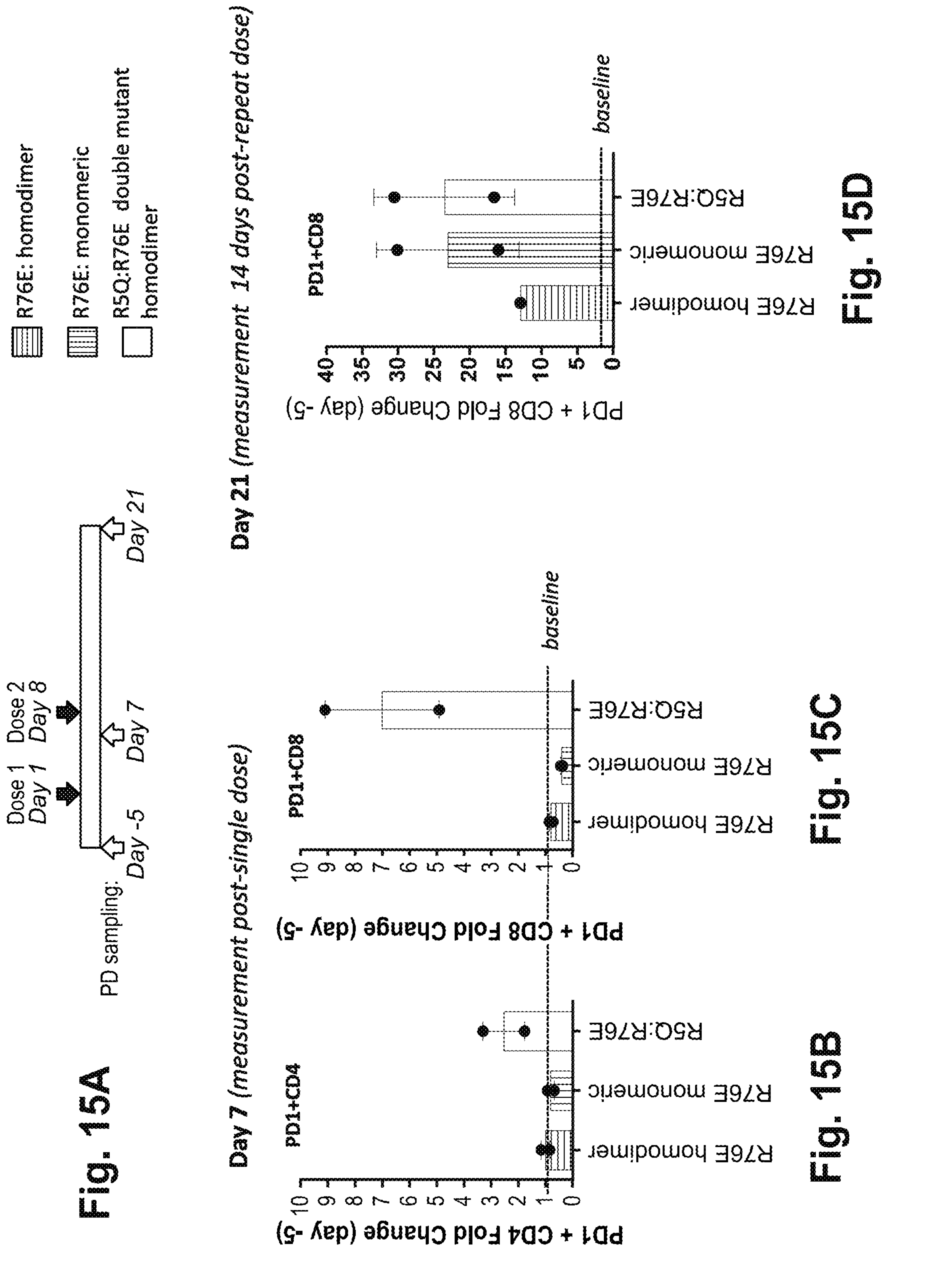

FIG. 15A represents a timeline of the cell sampling (open arrows) and of the administrations (closed arrows).

FIG. 15B represents a graph of the fold change in PD-$1^{+}$/$CD4^{+}$ cells (relative to Day −5) as measured on Day 7 in animals given a dose of (i) a fusion protein comprising anti-PD-1 mAb and an IL-21 R76E mutein (bar with horizontal lines), (ii) a fusion protein comprising anti-PD-1 mAb and an IL-21 R76E single mutein monomer (bar with vertical lines), or (iii) a fusion protein comprising anti-PD-1 mAb and an IL-21 R5Q/R76E double mutein homodimer (open bar) (each administered on Day 0).

FIG. 15C represents a graph of the fold change in PD-1$^{+}$/CD8$^{+}$ cells (relative to Day −5) as measured on Day 7 in animals given a dose of (i) a fusion protein comprising anti-PD-1 mAb and an IL-21 R76E mutein (bar with horizontal lines), (ii) a fusion protein comprising anti-PD-1 mAb and an IL-21 R76E single mutein monomer (bar with vertical lines), or (iii) a fusion protein comprising anti-PD-1 mAb and an IL-21 R5Q/R76E double mutein homodimer (open bar) (each administered on Day 0).

FIG. 15D represents a graph of the fold change in PD-1$^{+}$/CD8$^{+}$ cells (relative to Day −5) as measured on Day 21 in animals given a first dose of (i) a fusion protein comprising anti-PD-1 mAb and an IL-21 R76E mutein (bar with horizontal lines), (ii) a fusion protein comprising anti-PD-1 mAb and an IL-21 R76E single mutein monomer (bar with vertical lines), or (iii) a fusion protein comprising anti-PD-1 mAb and an IL-21 R5Q/R76E double mutein homodimer (open bar) (first dose administered on Day 0 and second dose administered on Day 8).

Figure 16:
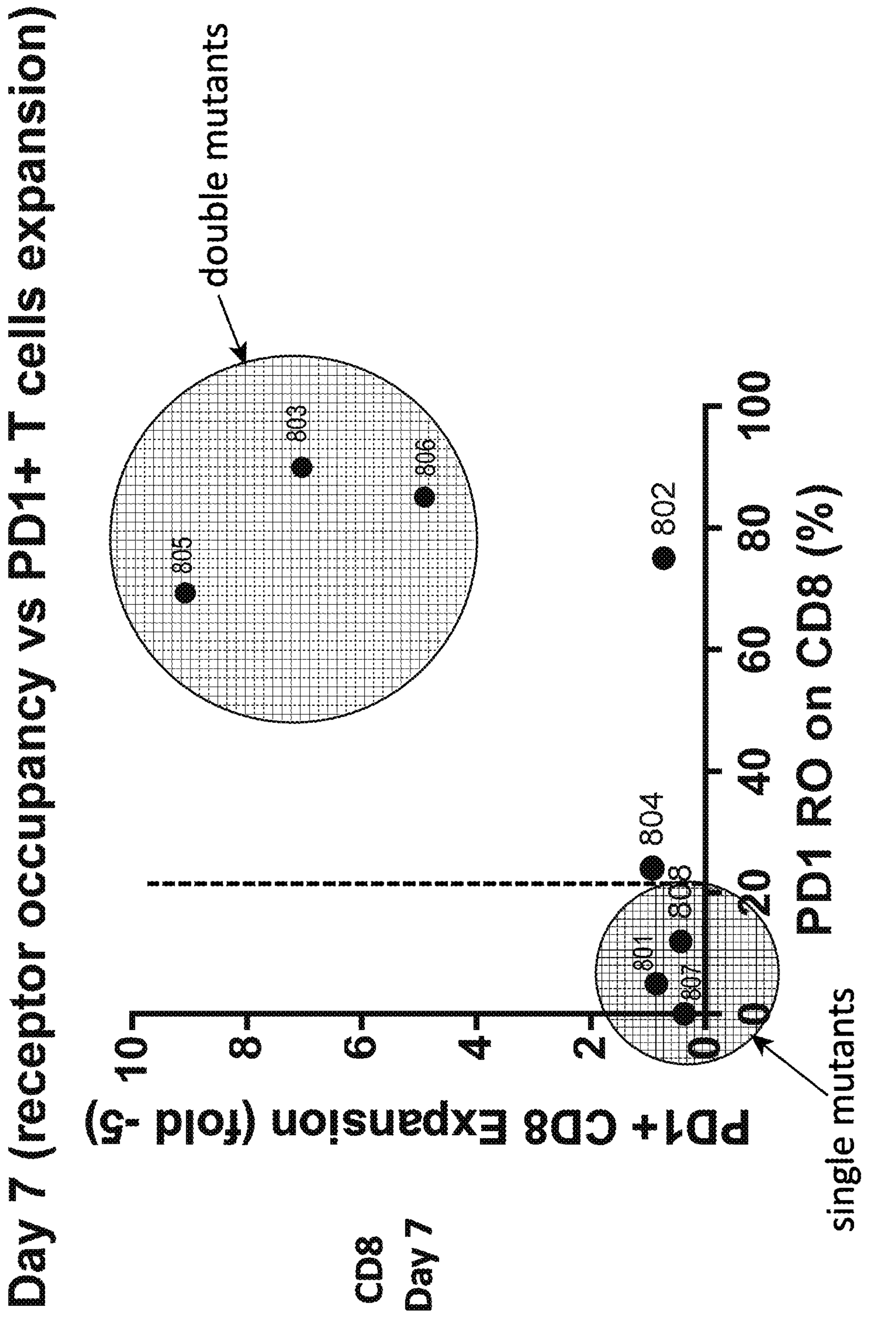

FIG. 16 represents a graph of the expansion of PD-1$^{+}$/CD8$^{+}$ cells (relative to Day −5) as a function of PD-1 receptor occupancy (RO) on PD-1$^{+}$/CD8$^{+}$ cells. IL-21 single mutants (801, 802, 807, and 808) are shown within the small circle and IL-21 double mutants (803, 804, 805, and 806) are shown in the large circle. These data demonstrate that superior pharmacokinetic properties of the double mutants allow for better target coverage and correlates with better pharmacodynamics responses, as measured by expansion of the PD-1$^{+}$ target population. The vertical dashed line indicates the general delineation between single and double mutants.

Figure 17:
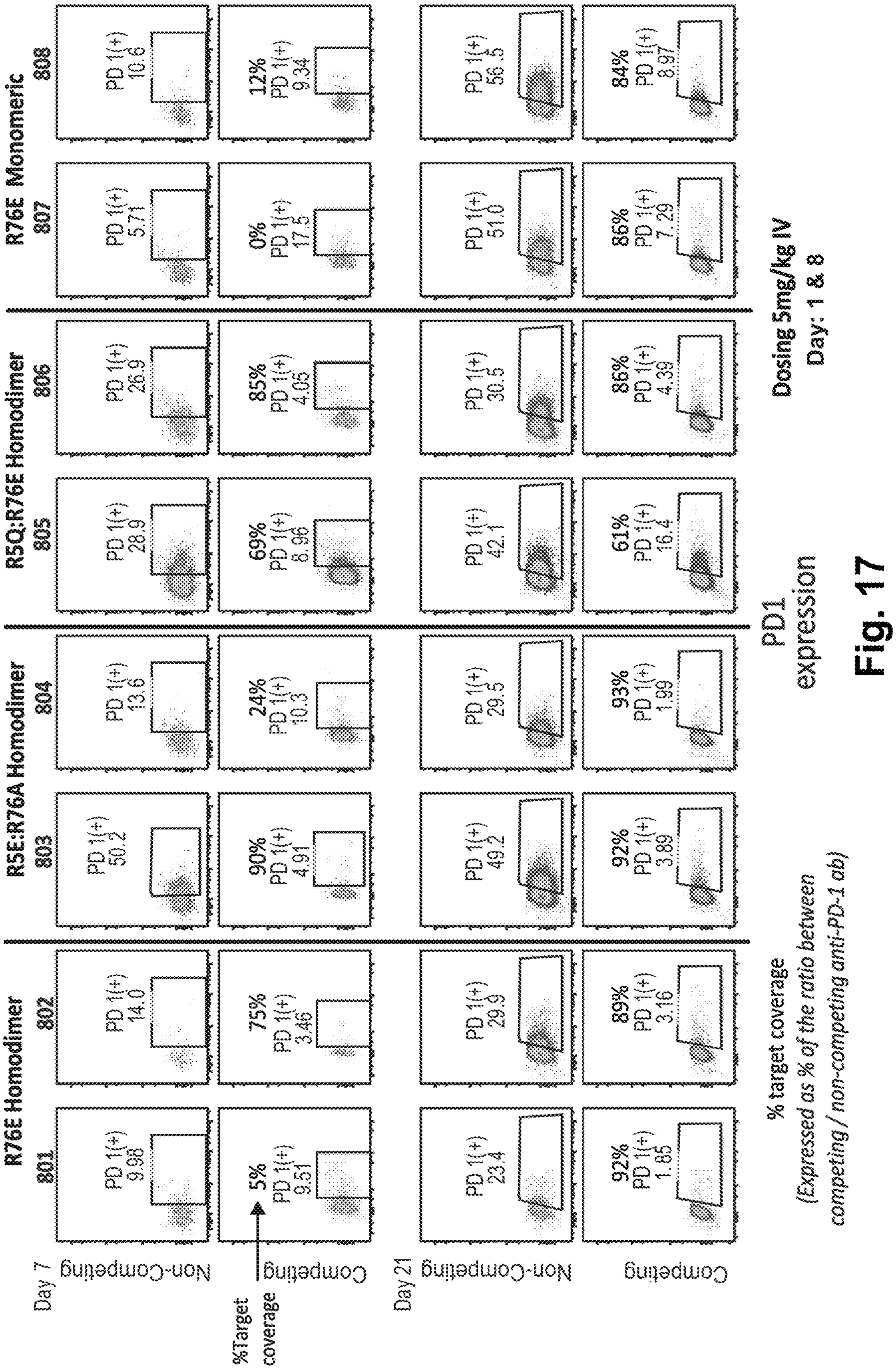

FIG. 17 represents flow plots of individual animals treated with either single mutant homodimer constructs (animals 801 and 802), double mutant homodimer constructs (animals 803-806), or single mutant monomeric constructs (animals 807 and 808). PD-1$^{+}$ T cells were detected by non-competing or competing detection antibody. Percent target coverage is calculated as a percentage of the ratio between competing and non-competing PD-1 antibody. The data show that all constructs demonstrate robust target coverage after repeat dosing on Day 21.

Figure 18A:
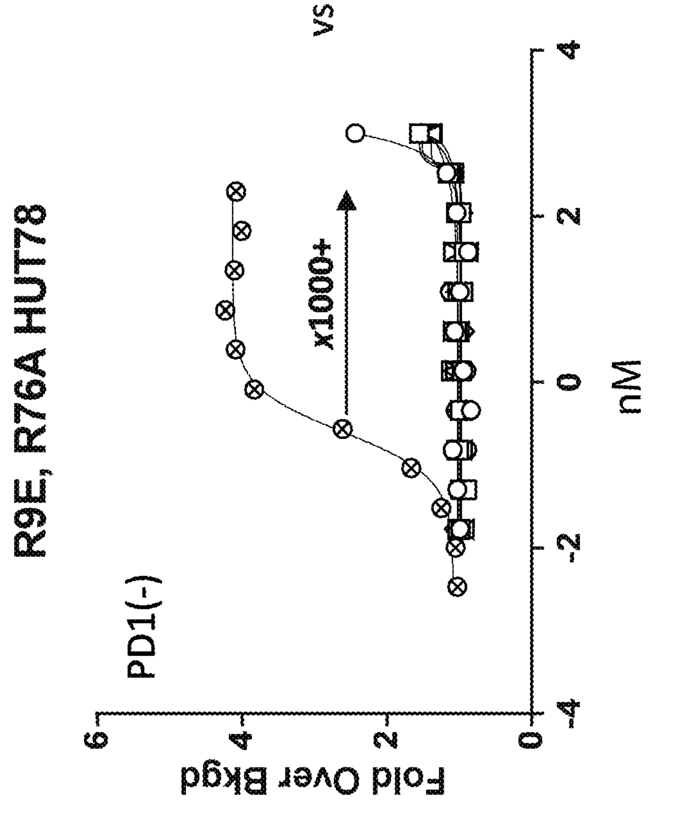

FIG. 18A represents a graph of the fold change (relative to rhIL-21 (solid line with circled X's)) of STAT3 activity of PD-1$^{-ve}$ Hut78 T cells exposed to a fusion protein comprising one of ten different anti-PD-1 mAbs and an IL-21 R5Q/R76E mutein homodimer. The ten anti-PD-1 mAbs included 20A2.003 (line with diamonds), 20C1.006 (line with open squares), 20C1.009 (line with triangles), and 22D4.006 (line with open circles).

Figure 18B:
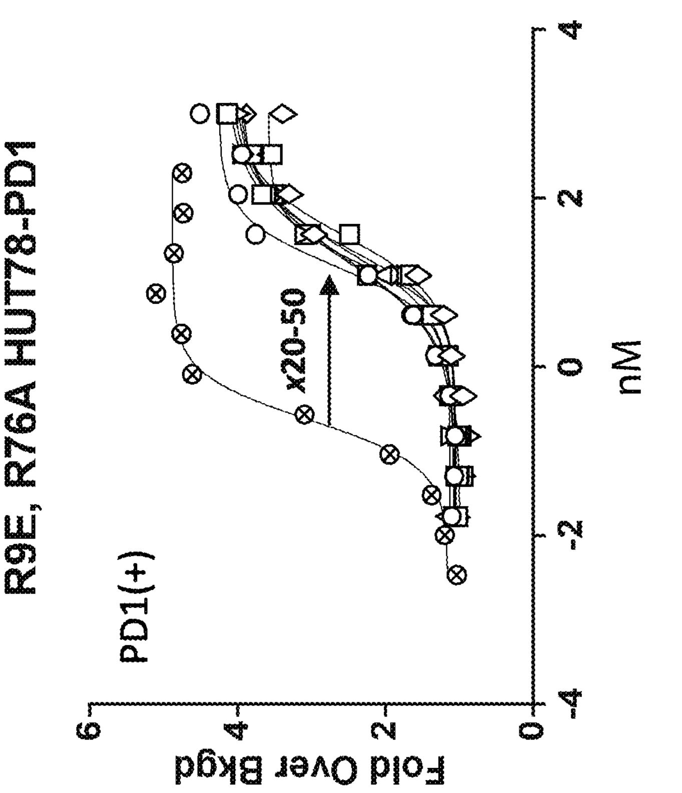

FIG. 18B represents a graph of the fold change (relative to rhIL-21 (solid line with circled X's)) of STAT3 activity of PD-1+ve Hut78 T cells exposed to a fusion protein comprising one of ten different anti-PD-1 mAbs and an IL-21 R5Q/R76E mutein homodimer. The ten anti-PD-1 mAbs included 20A2.003 (line with diamonds), 20C1.006 (line with open squares), 20C1.009 (line with triangles), and 22D4.006 (line with open circles). Comparison of FIG. 18A to FIG. 18B indicates that PD-1 targeting needed for pSTAT3 signaling and that the activity of the muteins is similar when fused to different anti-PD-1 mAbs.

Figure 19A:
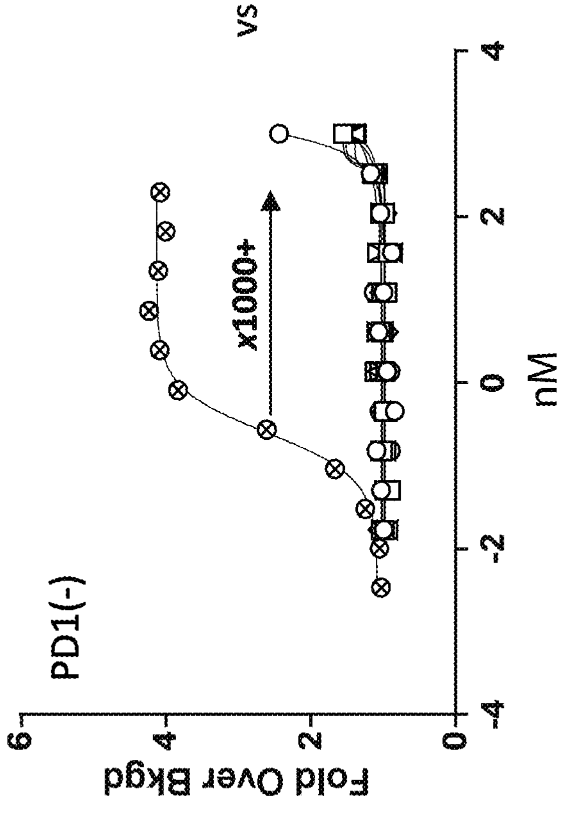

FIG. 19A represents a graph of the fold change (relative to rhIL-21 (solid line with circled X's)) of STAT3 activity of PD-1$^{-ve}$ Hut78 T cells exposed to a fusion protein comprising one of seven different anti-PD-1 mAbs and an IL-21 R9E/R76A mutein homodimer. The seven anti-PD-1 mAbs included 20A2.003 (line with open triangles), 20C1.006 (line with open squares), 20C1.009 (line with open diamonds), and 22D4.006 (line with open circles).

Figure 19B:
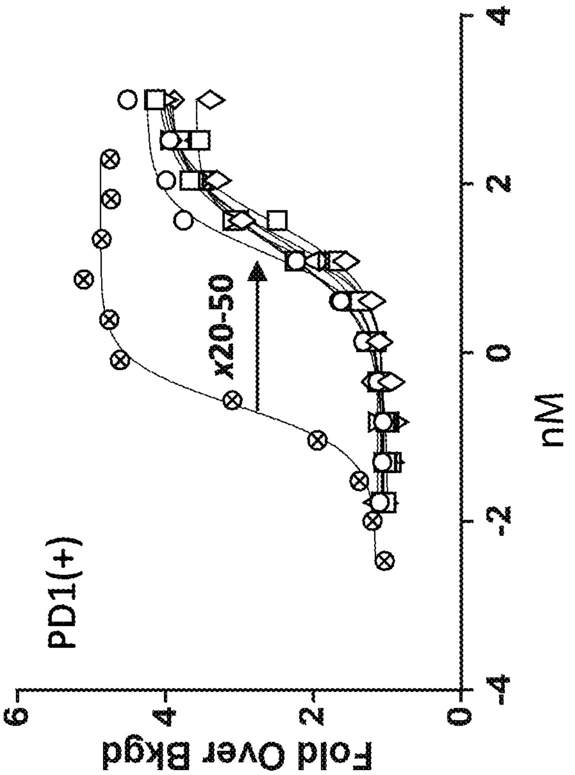

FIG. 19B represents a graph of the fold change (relative to rhIL-21 (solid line with circled X's)) of STAT3 activity of PD-1$^{+ve}$ Hut78 T cells exposed to a fusion protein comprising one of seven different anti-PD-1 mAbs and an IL-21 R9E/R76A mutein homodimer. Comparison of FIG. 19A to FIG. 19B indicates that PD-1 targeting needed for pSTAT3 signaling and that the activity of the muteins is similar when fused to different anti-PD-1 mAbs. The seven anti-PD-1 mAbs included 20A2.003 (line with open triangles), 20C1.006 (line with open squares), 20C1.009 (line with open diamonds), and 22D4.006 (line with open circles).

FIGS. 20A-20D represent the amount of pSTAT3 signaling observed with several anti-PD-1 mAb—IL-21 monomeric or dimeric double mutein fusions. Solid line with closed circles (top of graphs) is rhIL-21; dashed line with open circles (bottom of graphs) is IgG1 control; line with X's (bottom of graphs) is IgG2 control; dotted line with closed squares (bottom of graphs) is the 22D4.006 anti-PD-1 mAb (present as mAb; i.e., not as a fusion) used in the IL-21 mutein fusions; dashed line with open squares and dotted line with open diamonds (bottom of graphs) are control anti-PD-1 mAbs; remaining lines are anti-PD-1 mAb (22D4.006)—IL-21 monomeric or dimeric double mutein fusions (with various charge pair mutations) wherein the double mutants are R5E/R76A; R9E/R76A; R5A/R76E or R5Q/R76E. rhIL-21 demonstrates activity in both PD-1$^{-ve}$ and PD-1$^{+ee}$ cells, monomeric and homodimeric double mutein fusions are unable to demonstrate pSTAT3 (IL-21-based) activity in PD-1$^{-ve}$ cells, and monomeric and homodimeric double mutein fusions are able to demonstrate pSTAT3 (IL-21-based) activity in PD-1$^{+ve}$ cells. Thus, monomeric fusions with IL-21 double mutants exhibit similar levels of IL-21 activity attenuation in PD-1$^{-ve}$ cells and IL-21 activity rescue in PD-1$^{+ve}$ cells as their counterpart dimeric fusions.

Figure 20A:
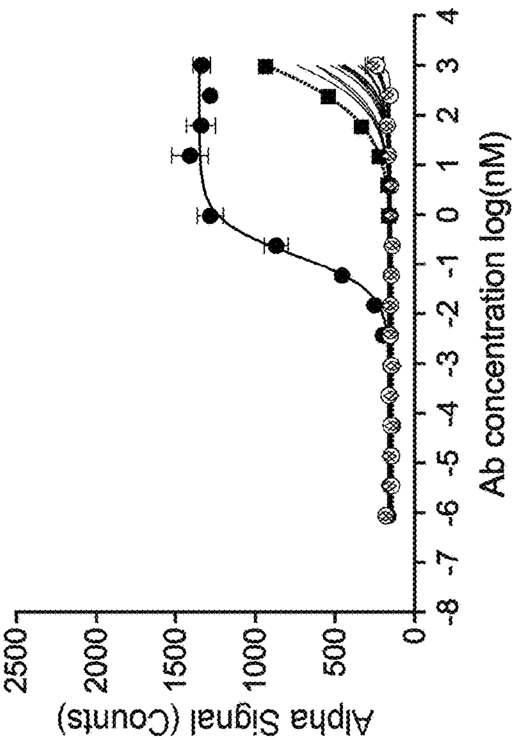
Figure 20B:
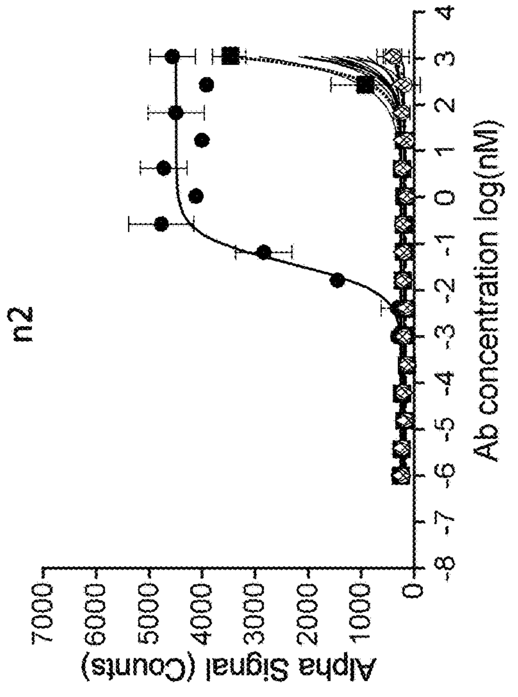
Figure 20C:
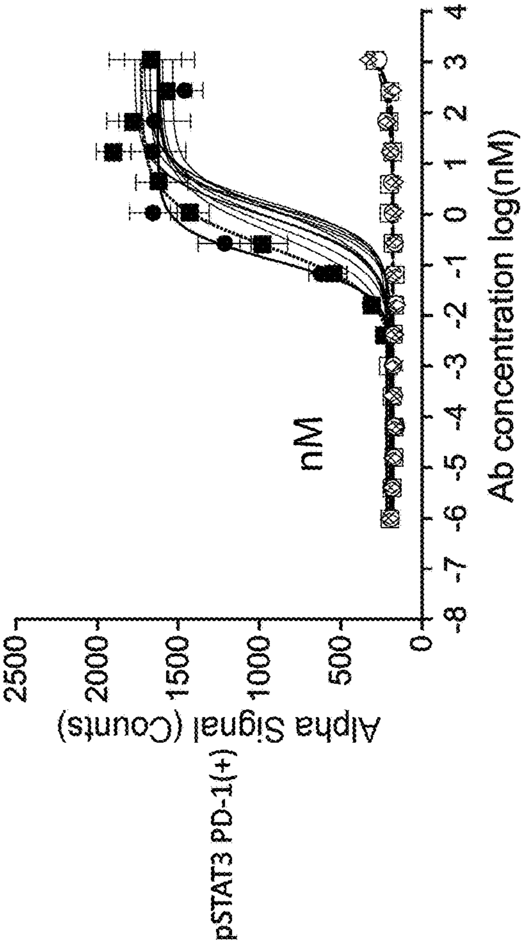
Figure 20D:
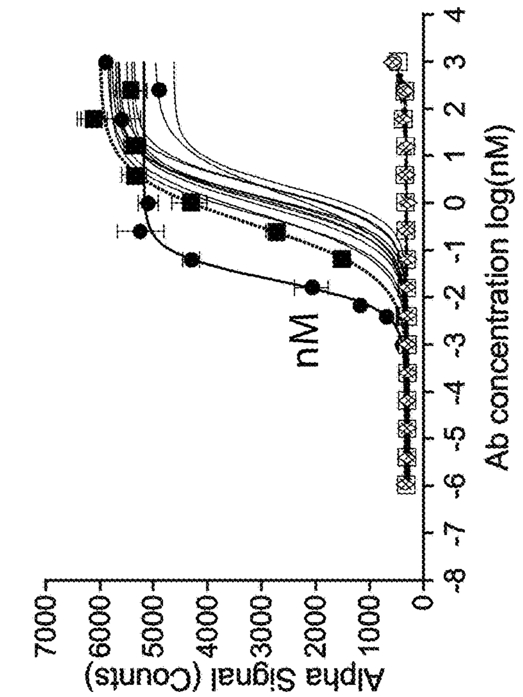

FIGS. 20A and 20B are duplicate runs of the pSTAT3 assay on PD-1$^{-ve}$ cells. FIGS. 20C and 20D are duplicate runs of the pSTAT3 assay on PD-1$^{+ve}$ cells.

Figure 21A:
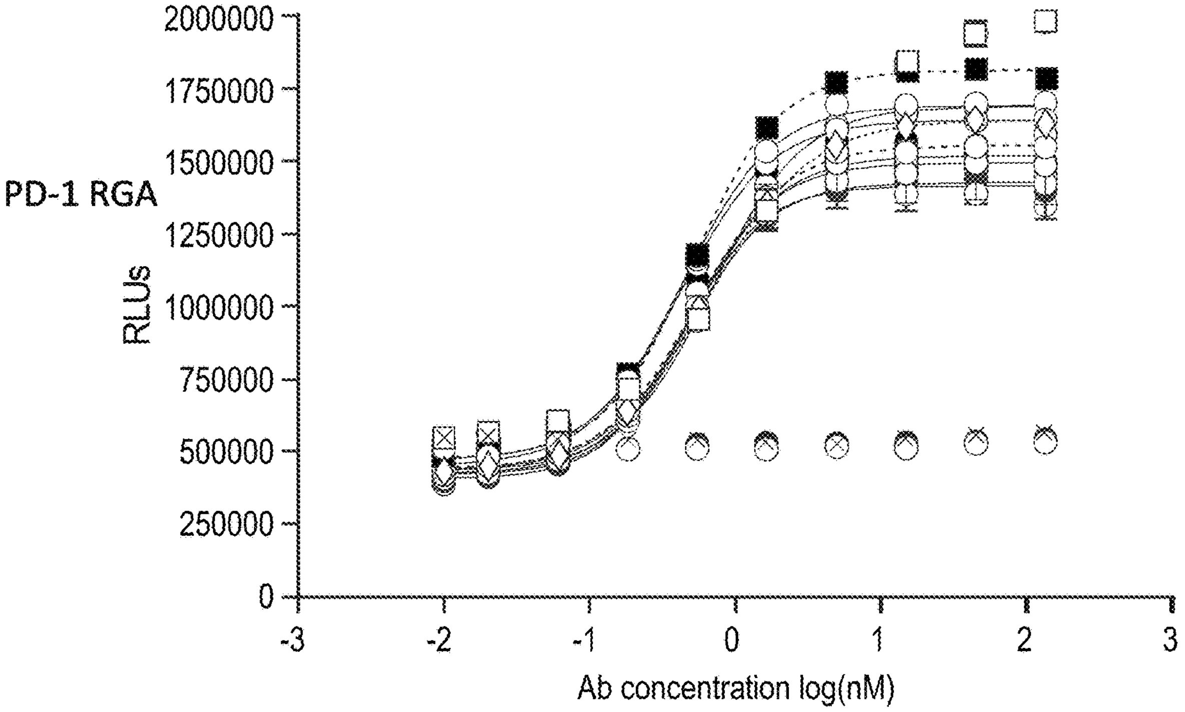
Figure 21B:
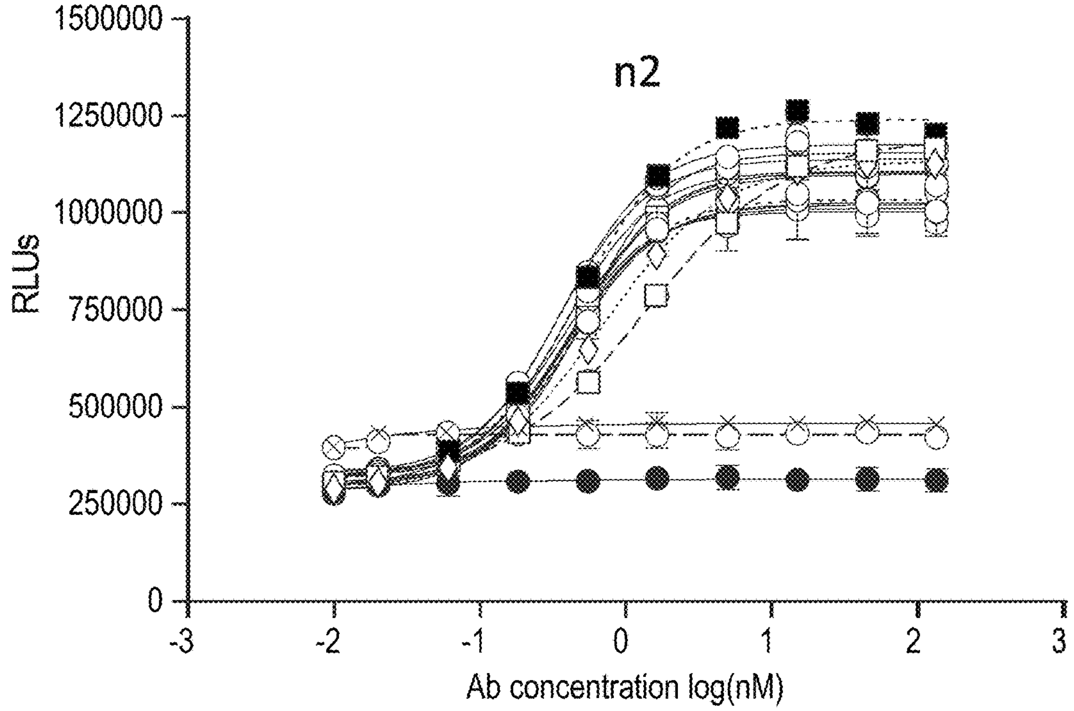

FIGS. 21A-21D represent the results of a PD-1 reporter gene assay (RGA; FIGS. 21A and 21B) and MLR assay (FIGS. 21C and 21D) with the same anti-PD-1 mAb (22D4.006)—IL-21 monomeric or dimeric double mutein fusions evaluated in FIGS. 20A-20D. FIGS. 21A-21D demonstrate that anti-PD-1 mAb (22D4.006)—IL-21 monomeric and dimeric double mutein fusions are able to induce PD-1 activity. Solid line with closed circles (bottom of graphs) is rhIL-21; line with open circles (bottom of graphs) is IgG1 control; line with X's (bottom of graphs) is IgG2 control; dashed line with closed squares (top of graphs) is the 22D4.006 anti-PD-1 mAb (present as mAb; i.e., not as a fusion) used in the IL-21 mutein fusions; dashed line with open squares and dotted line with open diamonds (top of graphs) are control anti-PD-1 mAbs; remaining lines are anti-PD-1 mAb—IL-21 monomeric or dimeric double mutein fusions. FIGS. 21A and 21B are duplicate runs of the PD-1 RGA assay. FIGS. 20C and 20D are duplicate runs of the MLR assay.

Figures 22A, 22B, 22C, 22D:
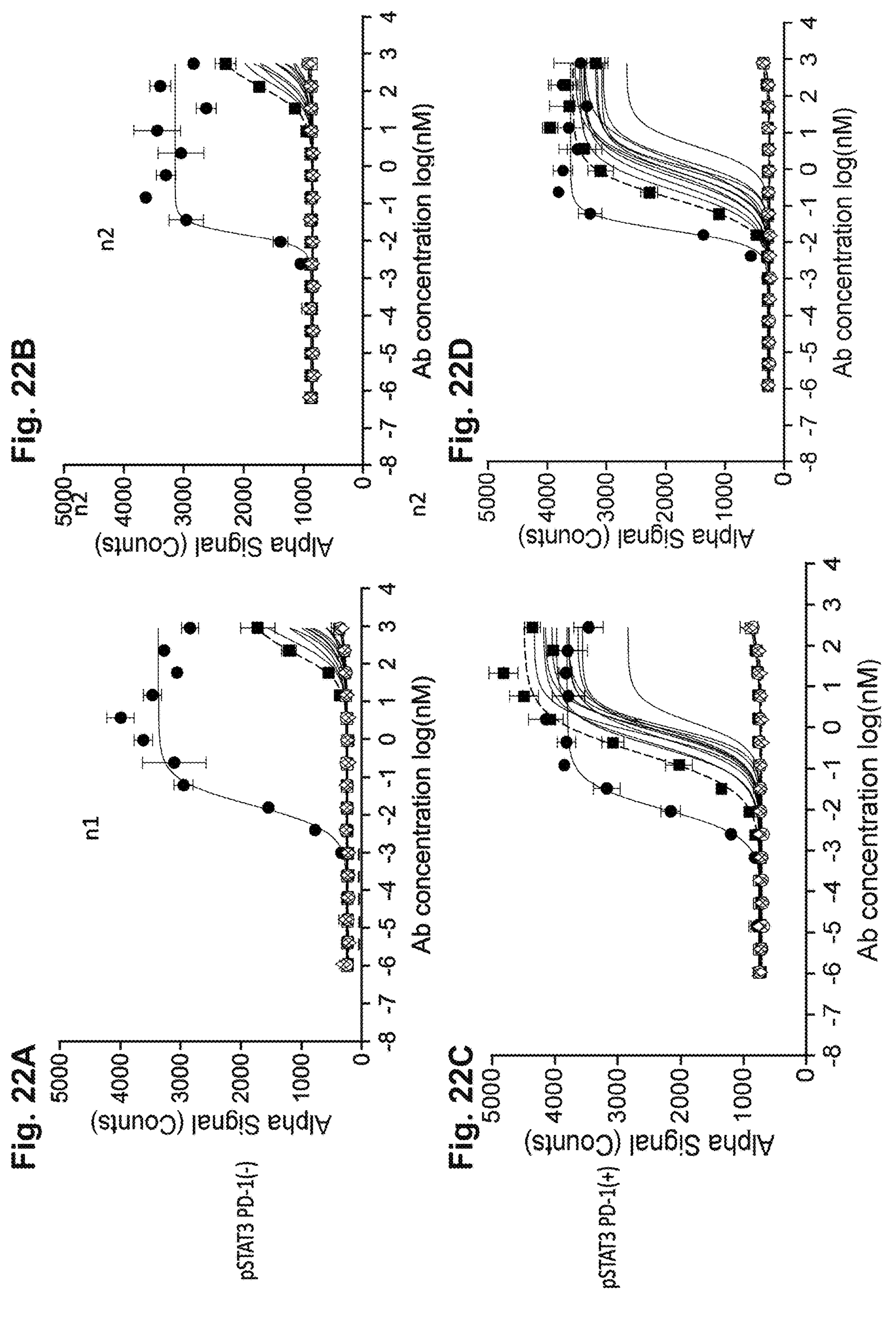

FIGS. 22A-22D represent the results of pSTAT3 assays testing the same constructs as those in FIGS. 20A-20D, except that a different anti-PD-1 mAb (20A2.003) is used in the anti-PD-1 mAb—IL-21 monomeric and dimeric double mutein fusions. The results in FIGS. 22A-22D are similar to those seen in FIGS. 20A-20D. Solid line with closed circles (top of graphs) is rhIL-21; dashed line with open circles (bottom of graphs) is IgG1 control; line with X's (bottom of graphs) is IgG2 control; dotted line with closed squares (bottom of graphs) is the 20A2.003 anti-PD-1 mAb (present as mAb; i.e., not as a fusion) used in the IL-21 mutein fusions; dashed line with open squares and dotted line with open diamonds (bottom of graphs) are control anti-PD-1 mAbs; remaining lines are anti-PD-1 mAb (20A2.003)—IL-21 monomeric or dimeric double mutein fusions (with various charge pair mutations) wherein the double mutants are R5E/R76A; R9E/R76A; R5A/R76E or R5Q/R76E. FIGS. 22A and 22B are duplicate runs of the pSTAT3 assay on PD-$1^{-ve}$ cells. FIGS. 22C and 22D are duplicate runs of the pSTAT3 assay on PD-$1^{+ve}$ cells.

Figure 23A:
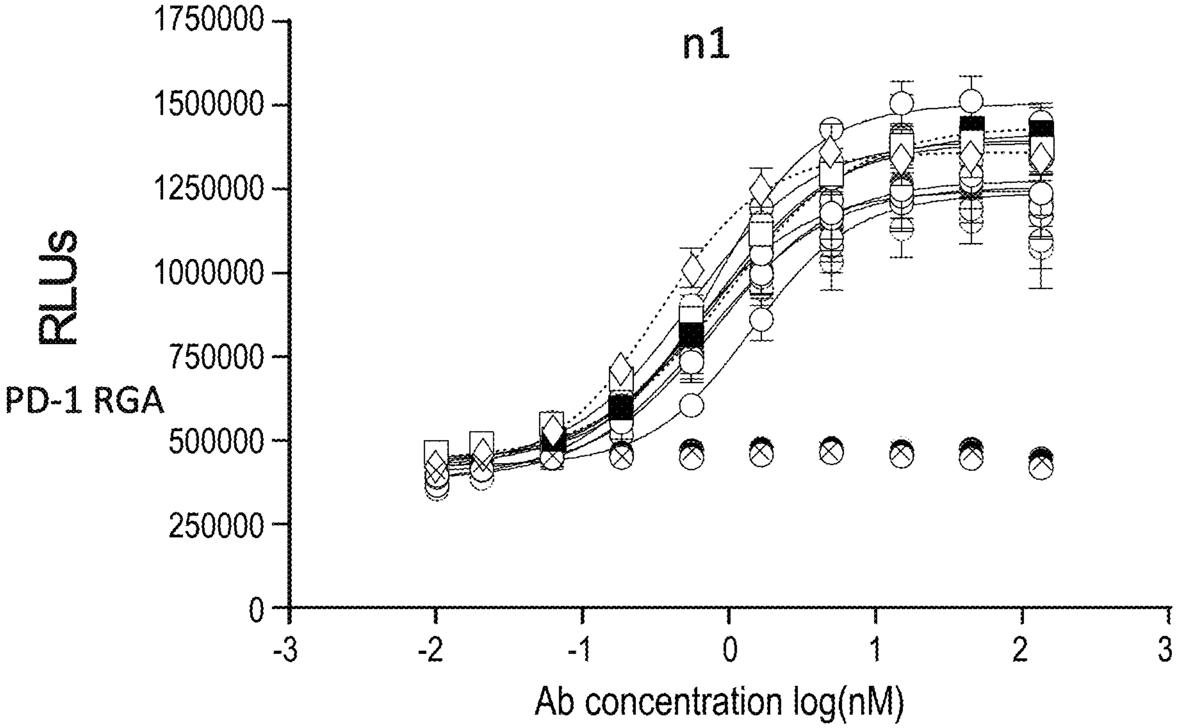
Figure 23B:
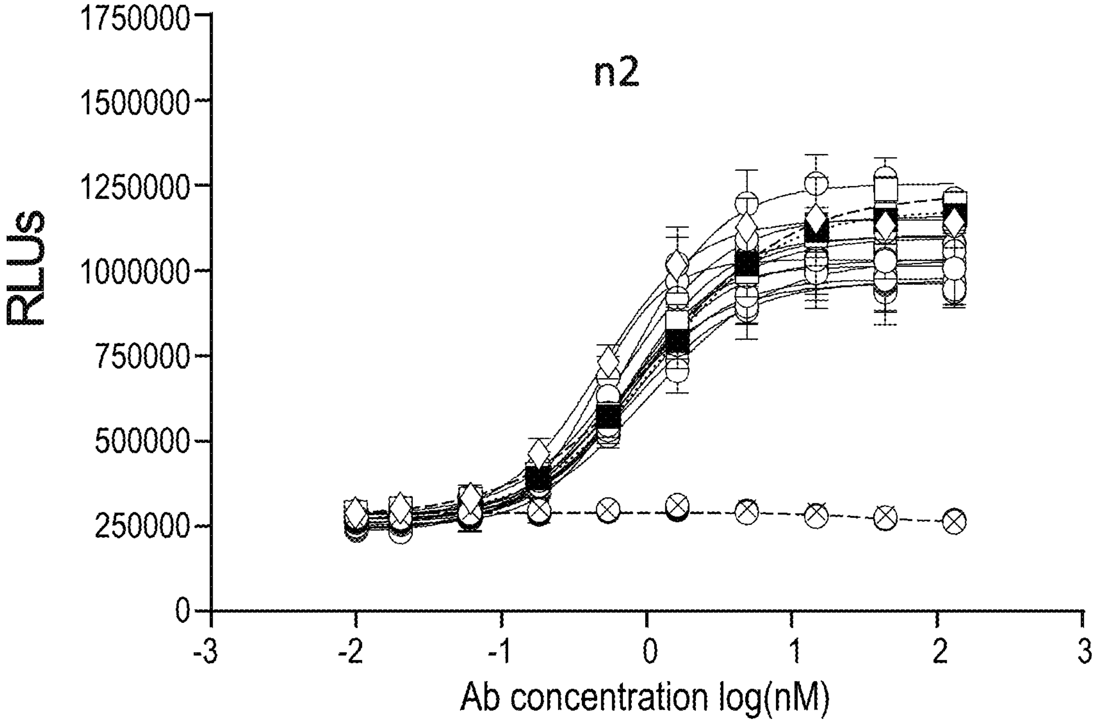
Figure 23C:
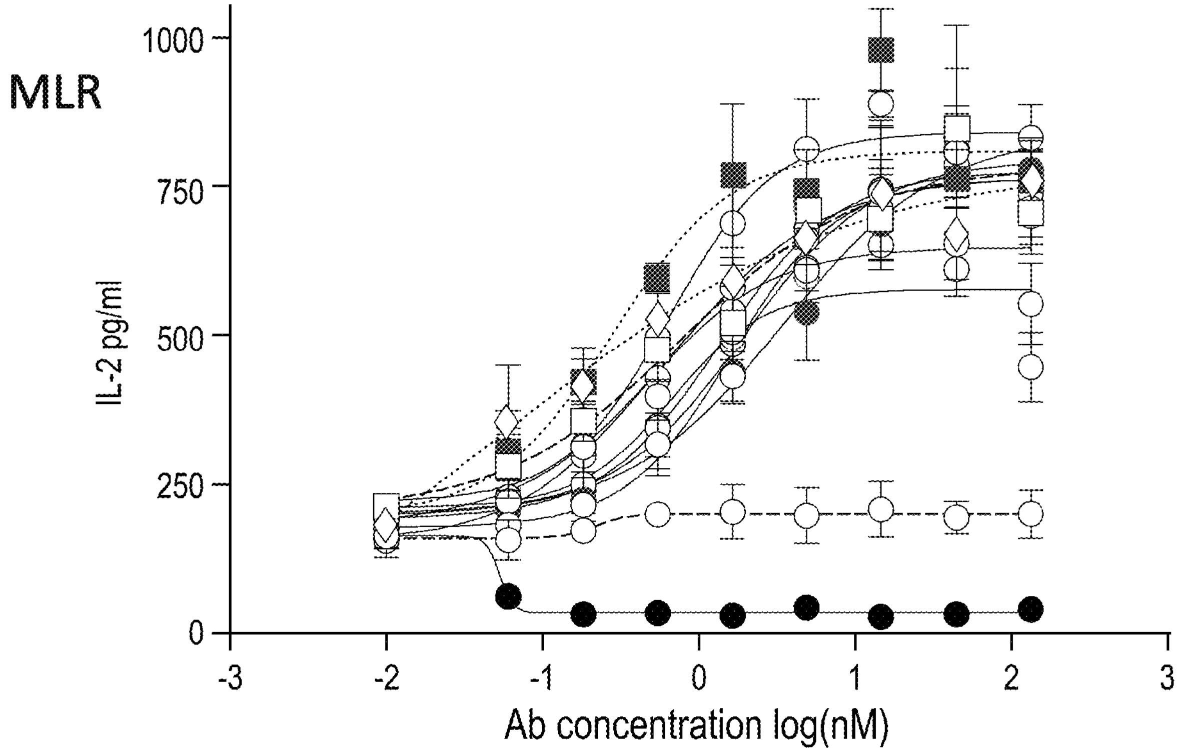
Figure 23D:
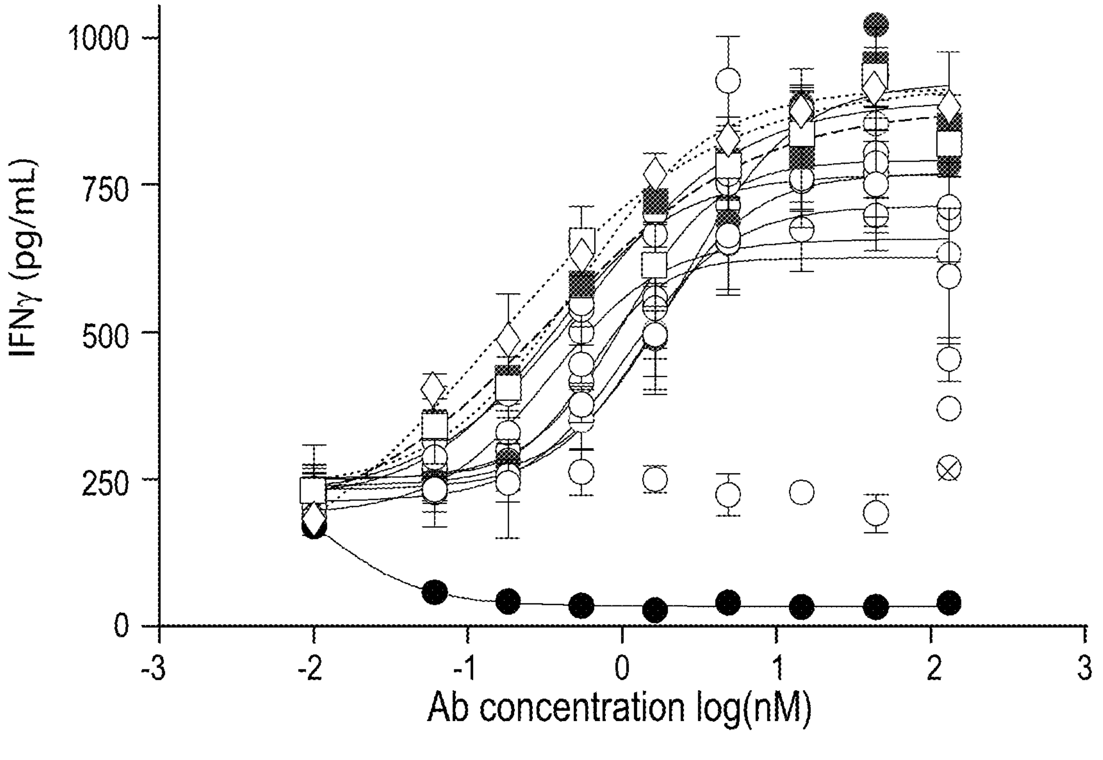

FIGS. 23A-23D represent the results of PD-1 reporter gene assays (FIGS. 23A and 23B) and MLR assays (FIGS. 23C and 23D) testing the same constructs as those in FIGS. 21A-21D, except that a different anti-PD-1 mAb (20A2.003) is used in the anti-PD-1 mAb—IL-21 monomeric and dimeric double mutein fusions. The results in FIGS. 23A-23D are similar to those seen in FIGS. 21A-21D. Solid line with closed circles (bottom of graphs) is rhIL-21; dashedline with open circles (bottom of graphs) is IgG1 control; line with X's (bottom of graphs) is IgG2 control; dotted line (top of graphs) is the 20A2.003 anti-PD-1 mAb (present as mAb; i.e., not as a fusion) used in the IL-21 mutein fusions; dashed line with open squares and dotted line with open diamonds (top of graphs) are control anti-PD-1 mAbs; remaining lines are anti-PD-1 mAb (20A2.003)—IL-21 monomeric or dimeric double mutein fusions. FIGS. 23A and 23B are duplicate runs of the PD-1 RGA assay. FIGS. 23C and 23D are duplicate runs of the MLR assay.

Figure 24:
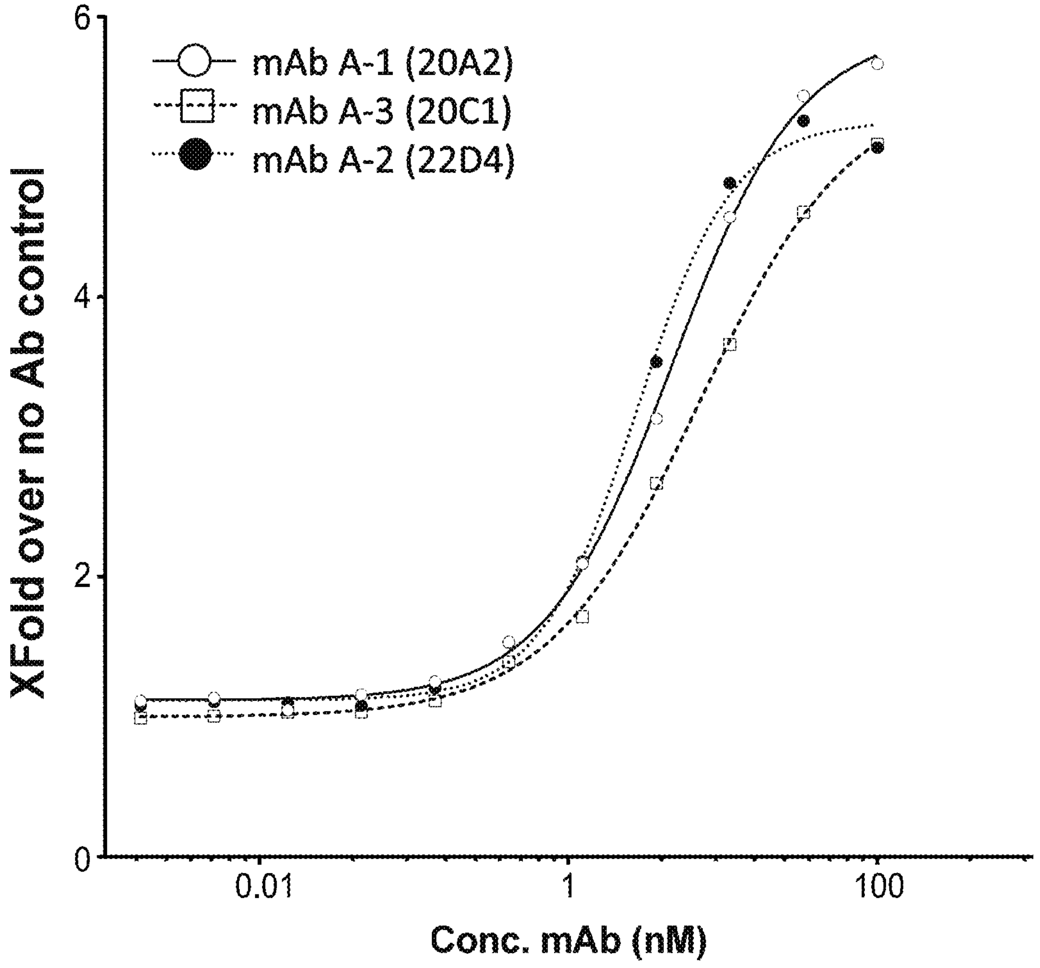

FIG. 24 represents a graph of the NFAT/luciferase activity of purified anti-PD-1 antibodies as a function of mAb concentration.

FIG. 25A is a graph of the fold change in the number of Ki67+/CD3+/CD4+ cells relative to baseline upon exposure to the fusion protein [22D4.017]-[R9E:R76A] (monomer) or to the anti-PD-antibody [22D4.017].

FIG. 25B is a graph of the fold change in the number of Ki67+/CD3+/CD8+ cells relative to baseline upon exposure to the fusion protein [22D4.017]-[R9E:R76A] (monomer) or to the anti-PD-antibody [22D4.017].

FIG. 25C is a graph of the fold change in the number of pSTAT3+/CD3+/CD4+ cells relative to baseline upon exposure to the fusion protein [22D4.017]-[R9E:R76A] (monomer) or to the anti-PD-antibody [22D4.017].

FIG. 25D is a graph of the fold change in the number of pSTAT3+/CD3+/CD8+ cells relative to baseline upon exposure to the fusion protein [22D4.017]-[R9E:R76A] (monomer) or to the anti-PD-antibody [22D4.017].

FIG. 25E is a graph of the fold change in the number of CD3+/CD4+ cells relative to baseline upon exposure to the fusion protein [22D4.017]-[R9E:R76A] (monomer) or to the anti-PD-1 antibody [22D4.017].

FIG. 25F is a graph of the fold change in the number of CD3+/CD8+ cells relative to baseline upon exposure to the fusion protein [22D4.017]-[R9E:R76A] (monomer) or to the anti-PD-1 antibody [22D4.017].

FIG. 25G is a graph of the fold change in the number of PD-1+/CD3+/CD4+ cells relative to baseline upon exposure to the fusion protein [22D4.017]-[R9E:R76A] (monomer) or to the anti-PD-antibody [22D4.017].

FIG. 25H is a graph of the fold change in the number of PD-1+/CD3+/C84+ cells relative to baseline upon exposure to the fusion protein [22D4.017]-[R9E:R76A] (monomer) or to the anti-PD-antibody [22D4.017].

FIG. 25I is a graph of the fold change in the amount of serum perforin relative to baseline upon 72 hours of exposure to the fusion protein [22D4.017]-[R9E:R76A] (monomer) or to the anti-PD-antibody [22D4.017].

FIG. 25J is a graph of the % Ki67+ cells relative to baseline as a function of fold increase in perforin upon 72 hour exposure to the fusion protein [22D4.017]-[R9E:R76A] (monomer) or to the anti-PD-1 antibody [22D4.017].

FIG. 26A is a graph of the absorbance (nm) as a function of time (sec) used to determine the indicated $K_D$ of antibody 22D4.017 for human PD-1 antigen.

FIG. 26B is a graph of the absorbance (nm) as a function of time (sec) used to determine the indicated $K_D$ of antibody 20C1.009 for human PD-1 antigen.

FIG. 26C is a graph of the absorbance (nm) as a function of time (sec) used to determine the indicated $K_D$ of antibody 20A2.003 for human PD-1 antigen.

FIG. 26D is a graph of the absorbance (nm) as a function of time (sec) used to determine the indicated $K_D$ of an IgG1 anti-PD-1 mAb, for human PD-1 antigen.

FIG. 26E is a graph of the absorbance (nm) as a function of time (sec) used to determine the indicated $K_D$ of an IgG4 PD-1 mAb for human PD-1 antigen.

FIG. 26F is a graph of the absorbance (nm) as a function of time (sec) used to determine the indicated $K_D$ of 22D4.017 for cyno PD-1 antigen.

FIG. 26G is a graph of the absorbance (nm) as a function of time (sec) used to determine the indicated $K_D$ of antibody 20C1.009 for cyno PD-1 antigen.

FIG. 26H is a graph of the absorbance (nm) as a function of time (sec) used to determine the indicated $K_D$ of antibody 20A2.003 for cyno PD-1 antigen.

FIG. 26I is a graph of the absorbance (nm) as a function of time (sec) used to determine the indicated $K_D$ of an IgG1 anti-PD-1 mAb for cyno PD-1 antigen.

FIG. 26J is a graph of the absorbance (nm) as a function of time (sec) used to determine the indicated $K_D$ of an IgG4 anti-PD-1 mAb for cyno PD-1 antigen.

Figure 27:
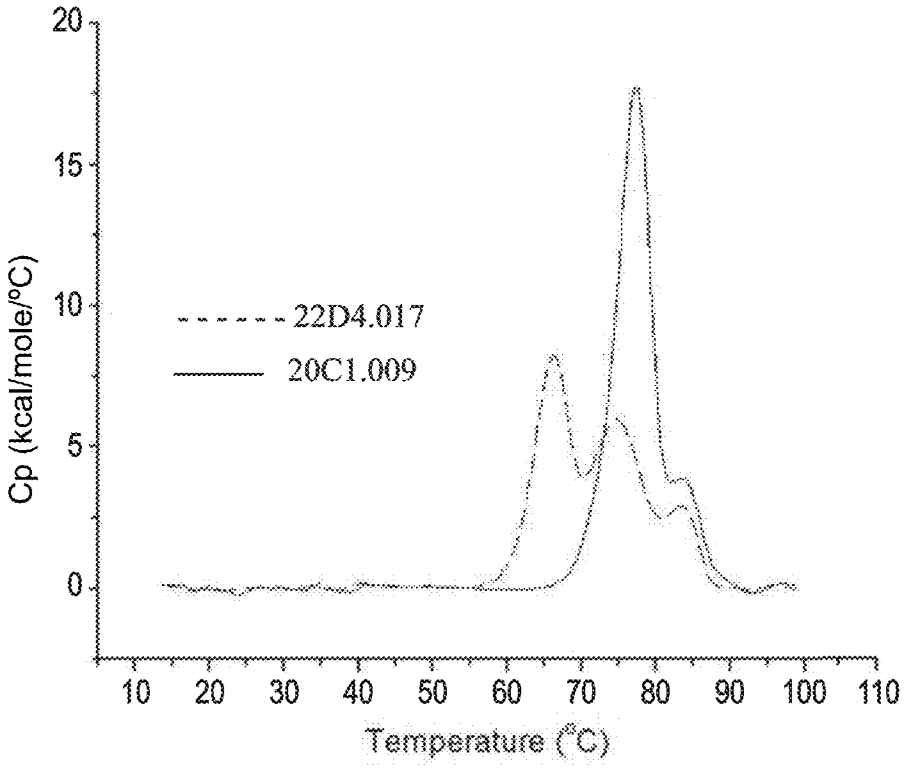

FIG. 27 is a graph of the Cp (kcal/mole/° C.) as a function of temperature for anti-PD-1 antibodies 22D4.017 and 20C1.009.

Figure 28:
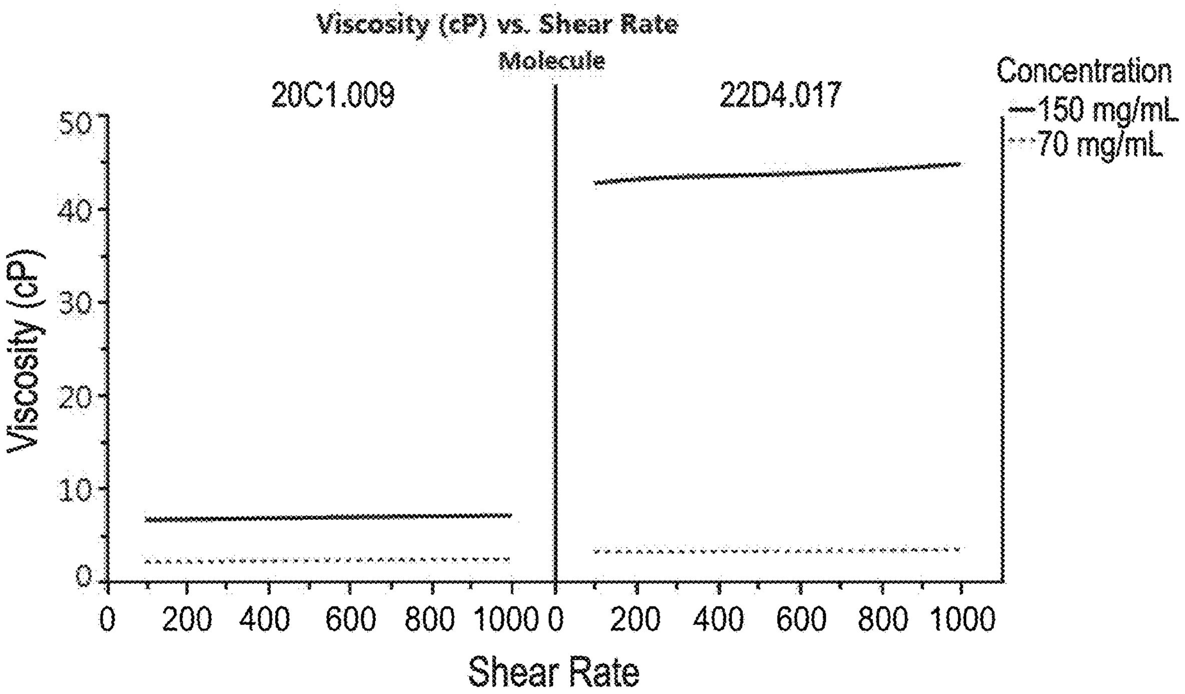
Figures 29A, 29B, 29C, 29D:
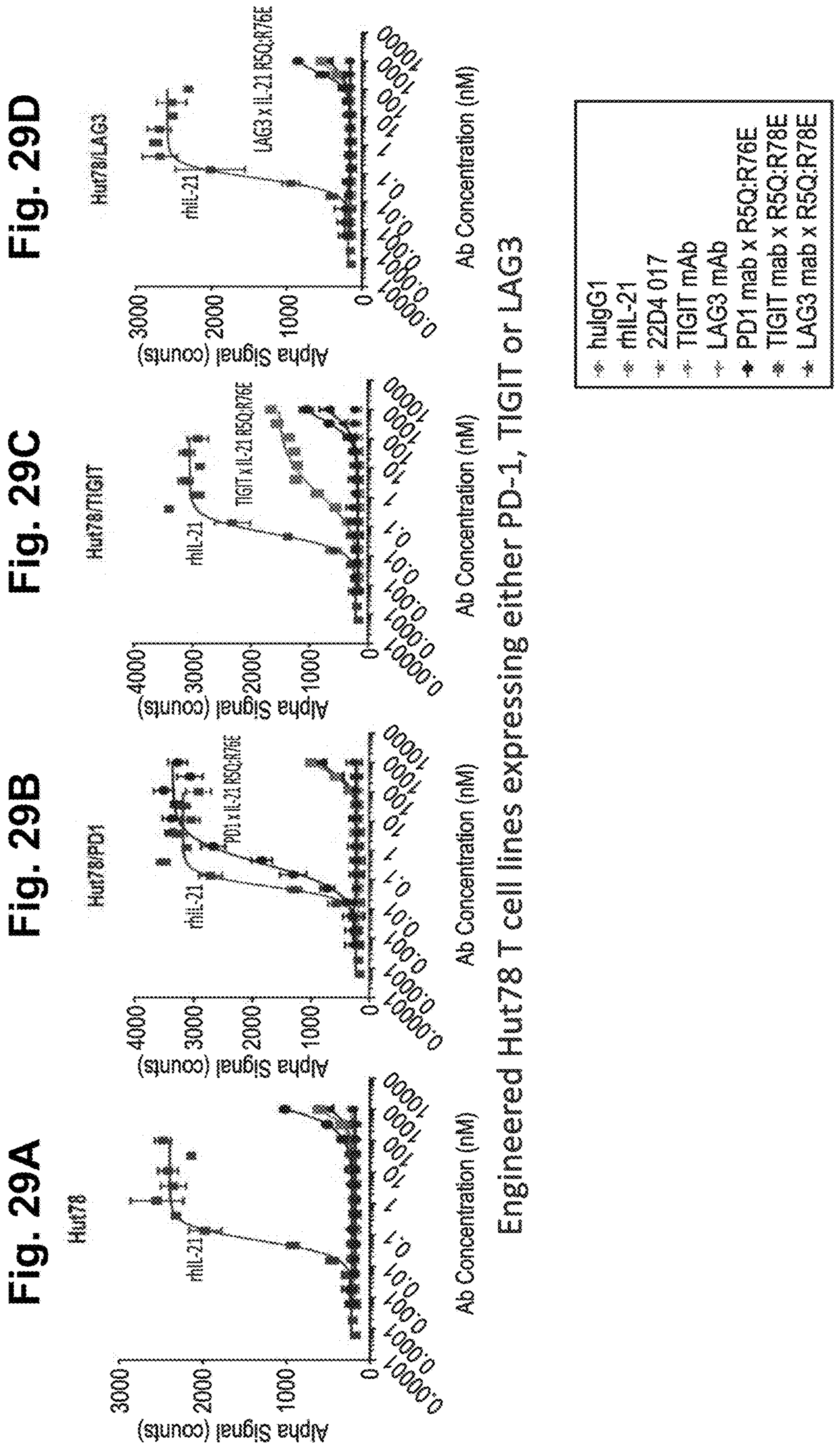

FIG. 28 is a graph of the viscosity plotted against shear rate for anti-PD-1 antibodies 22D4.017 and 20C1.009.

FIGS. 29A-29D are a series of graphs plotting the signal as a function of antibody concentration in (FIG. 29A) a variant Hut78 T cell line that is PD-1 positive, (FIG. 29B) a variant Hut78 T cell line that is TIGIT positive, (FIG. 29C) a variant Hut78 T cell line that is LAG3 positive, and (FIG. 29D) the parental Hut78 T cell line which does not endogenously express PD-1, TIGIT or LAG3.

Figure 30A:
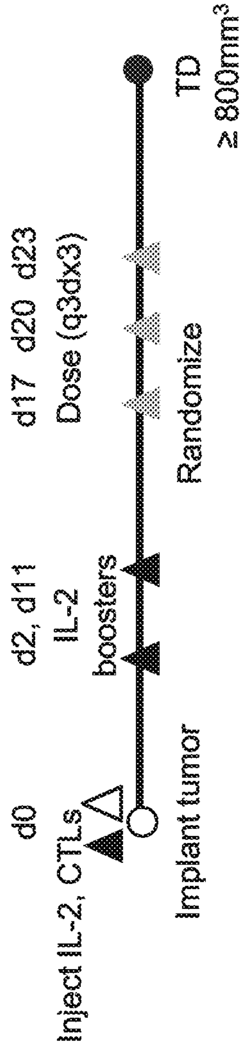
Figure 30B:
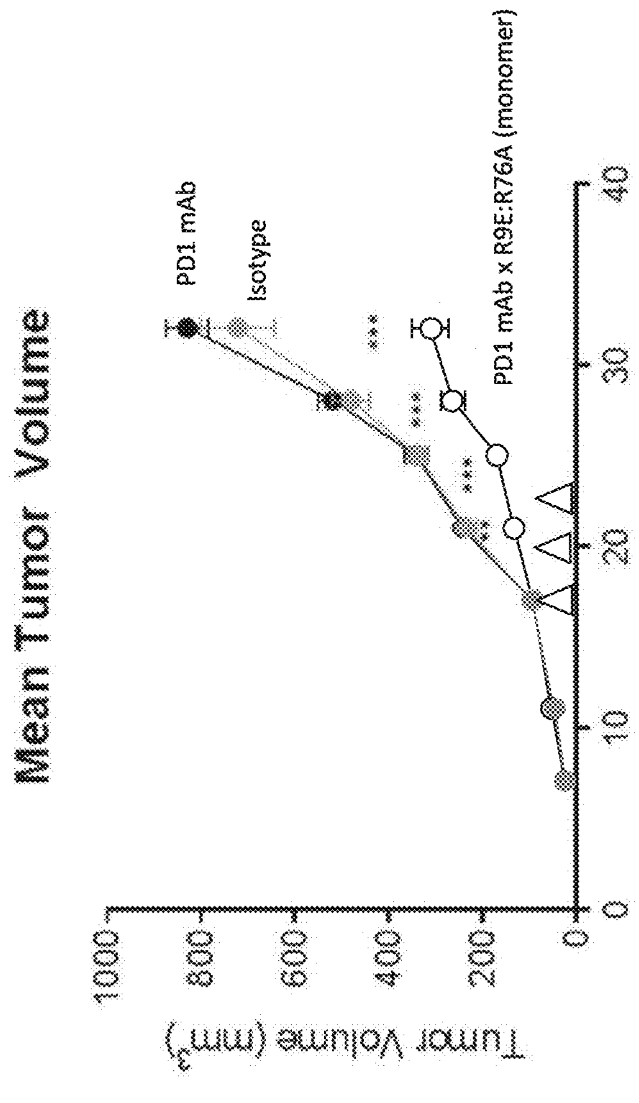
Figure 30C:
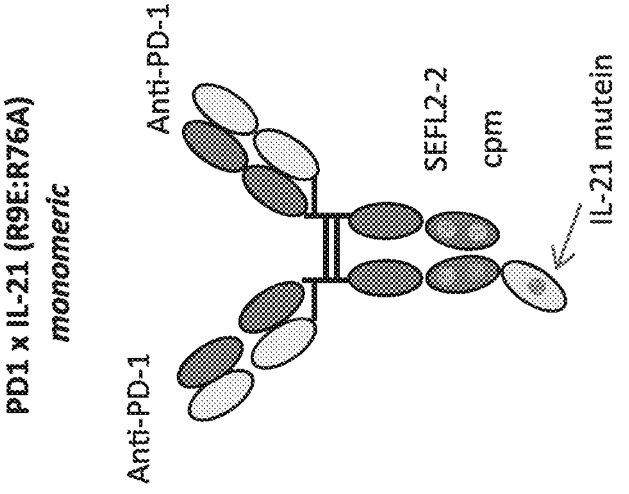

FIG. 30A is an illustration summarizing the experimental design of the study. FIG. 30B is a graph of in vivo activity as measured by tumor volume ($mm^3$) as a function of time (days). P values were calculated with one-way Anova with Turkey's post hoc test and were as follow; Day 21: P=0.0023 (anti-PD-1 mAb vs anti-PD-1 mAb×R9E:R76A monomer) and P=0.0056 (Isotype vs anti-PD-1 mAb×R9E:R76A monomer); Day 24: P=0.0001 (anti-PD-1 mAb vs anti-PD-1 mAb×R9E:R76A monomer) and P=0.0001 (Isotype vs anti-PD-1 mAb×R9E:R76A monomer); Day 28: P=0.0001 (anti-PD-1 mAb vs anti-PD-1 mAb×R9E:R76A monomer) and P=0.0012 (Isotype vs anti-PD-1 mAb×R9E:R76A monomer); Day 32: P=0.0001 (anti-PD-1 mAb vs anti-PD-1 mAb×R9E:R76A monomer) and P=0.0001 (Isotype vs anti-PD-1 mAb×R9E:R76A monomer). FIG. 30C is an illustration of the PD1 mAb×R9E:R76A (monomer).

Figure 30F:
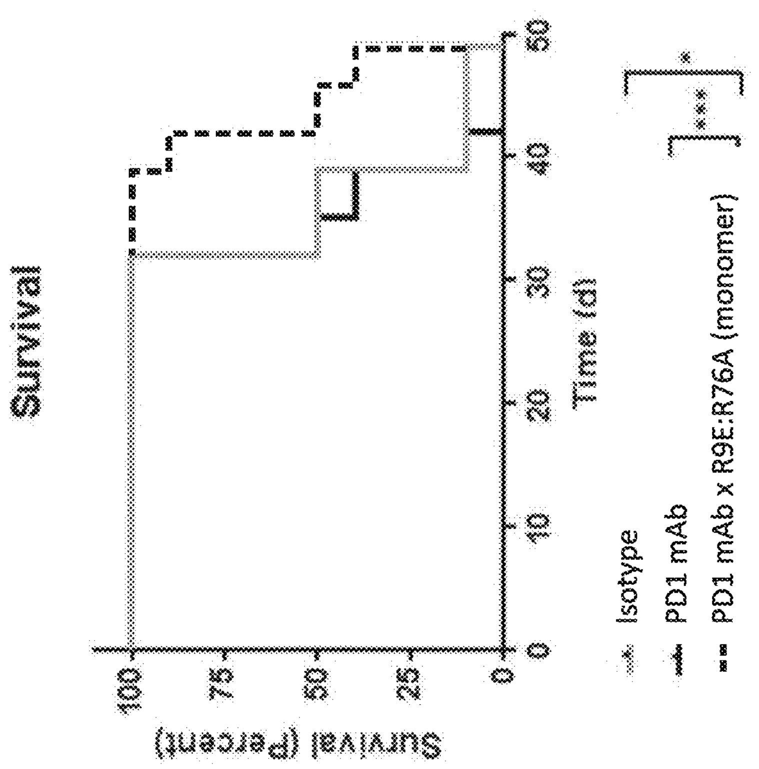
Figure 30E:
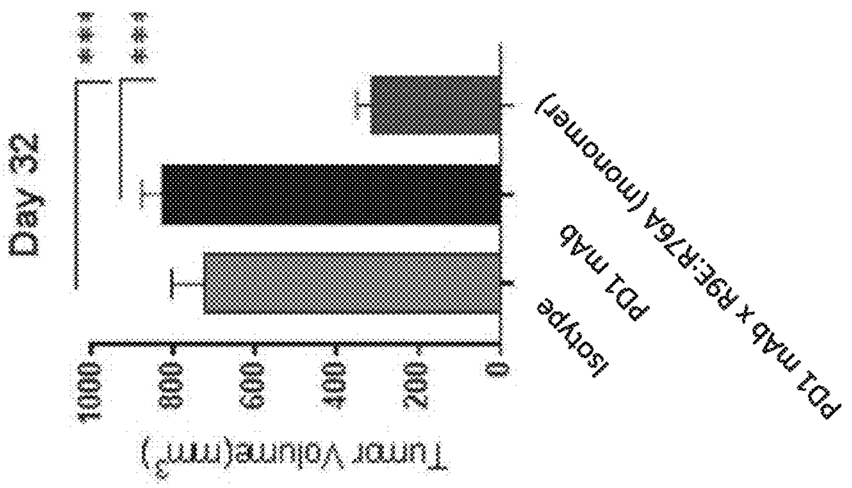
Figure 30D:
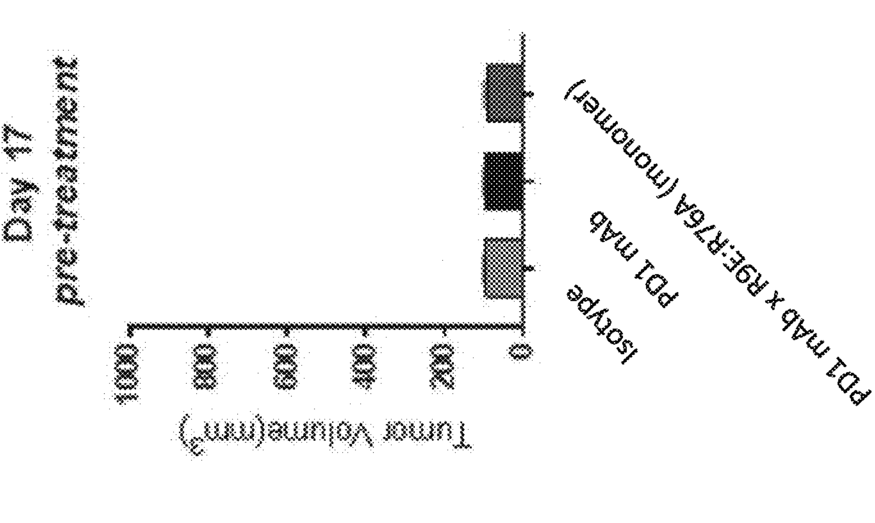

FIGS. 30D and 30E represent a summary of tumor volume at randomization (day 17) and pre-treatment (FIG. 30D) and at day 32 (FIG. 30E). P values were calculated using one-way Anova with a Turkey's post hoc test. P=0.0001 (anti-PD-1 mAb vs anti-PD-1 mAb×R9E:R76A monomer) and P=0.0001 (Isotype vs anti-PD-1 mAb×R9E:R76A monomer).

FIG. 30F is a graph of survival of tumor bearing mice. P values of log-rank (Mantel-Cox) test were as follow; P=0.0037 (Isotype vs anti-PD-1 mAb×R9E:R76A monomer), P=0.0001 (anti-PD-1 mAb monotherapy vs anti-PD-1 mAb×R9E:R76A monomer).

Figure 31:
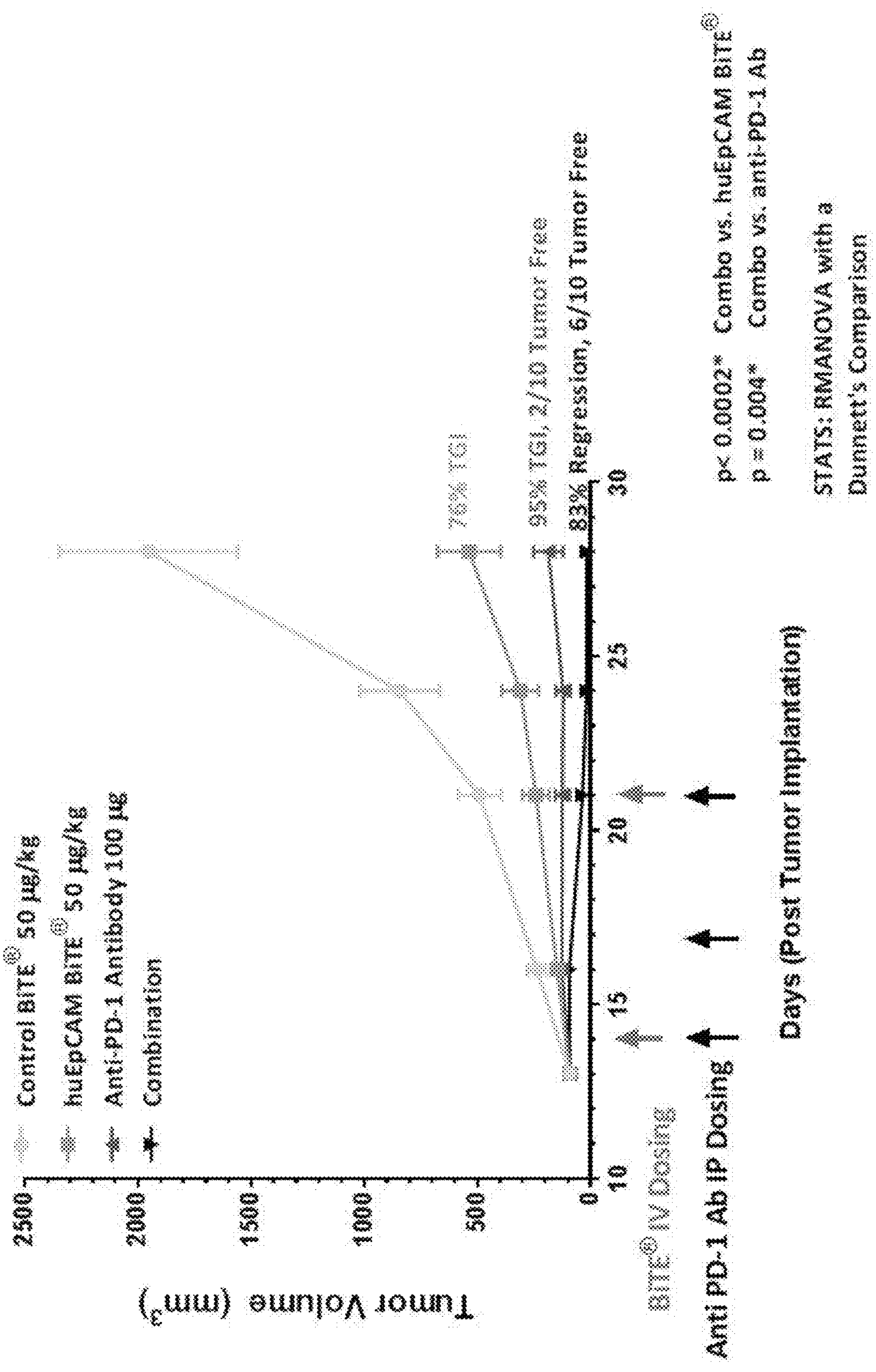

FIG. 31 is a graph demonstrating that the combination of single chain antibody constructs and an anti-PD-1 antibody results in significant tumor growth inhibition versus either single agent.

Figure 32:
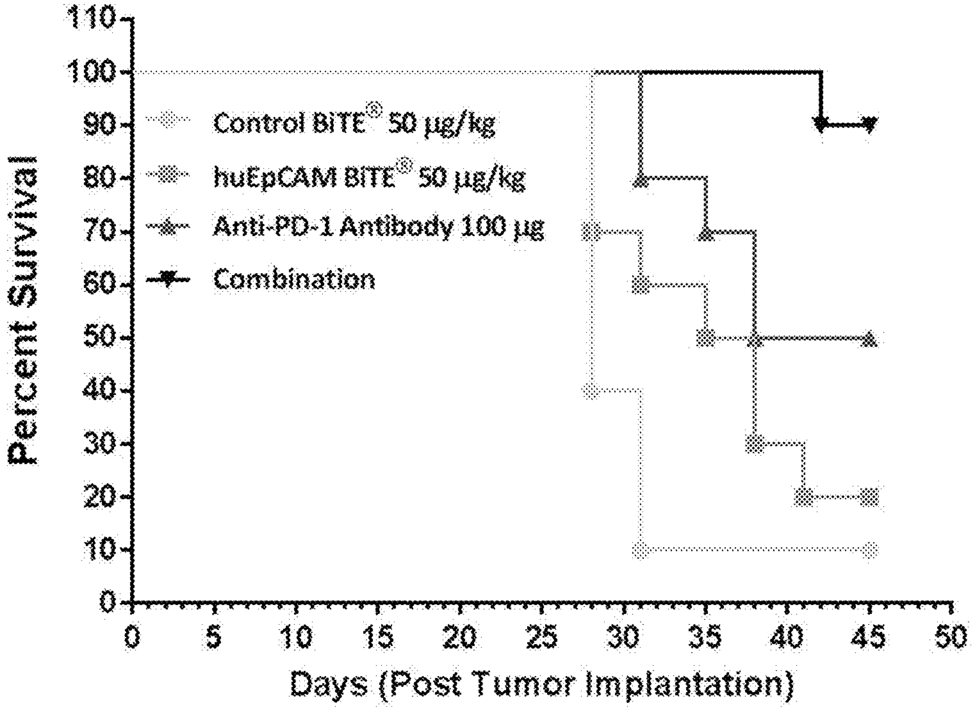

FIG. 32 is graph demonstrating that the combination of single chain antibody constructs and an anti-PD-1 antibody results in improved survival versus either single agent.

Figure 33A:
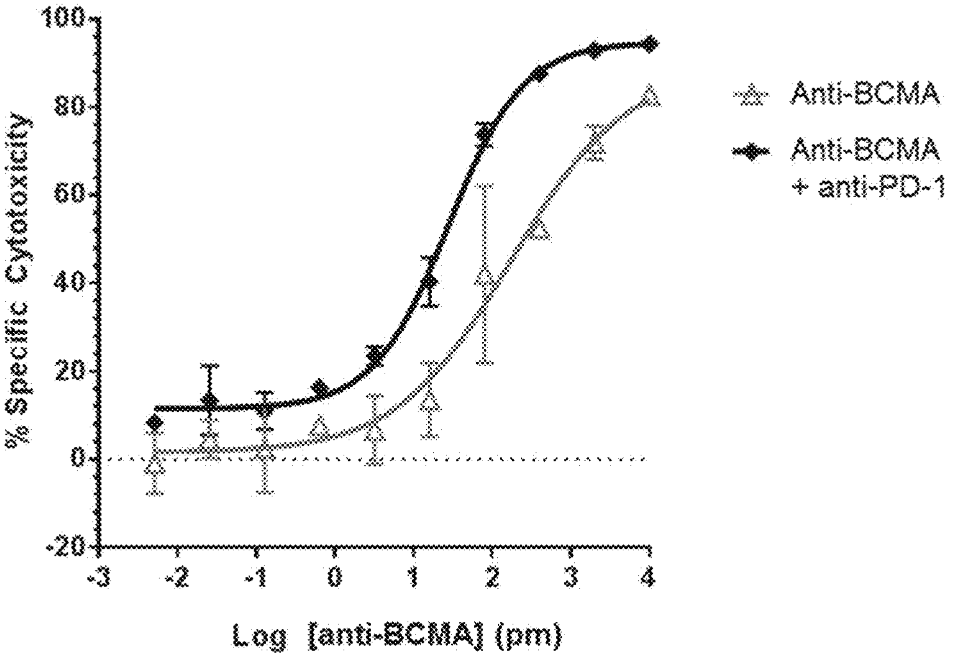
Figure 33B:
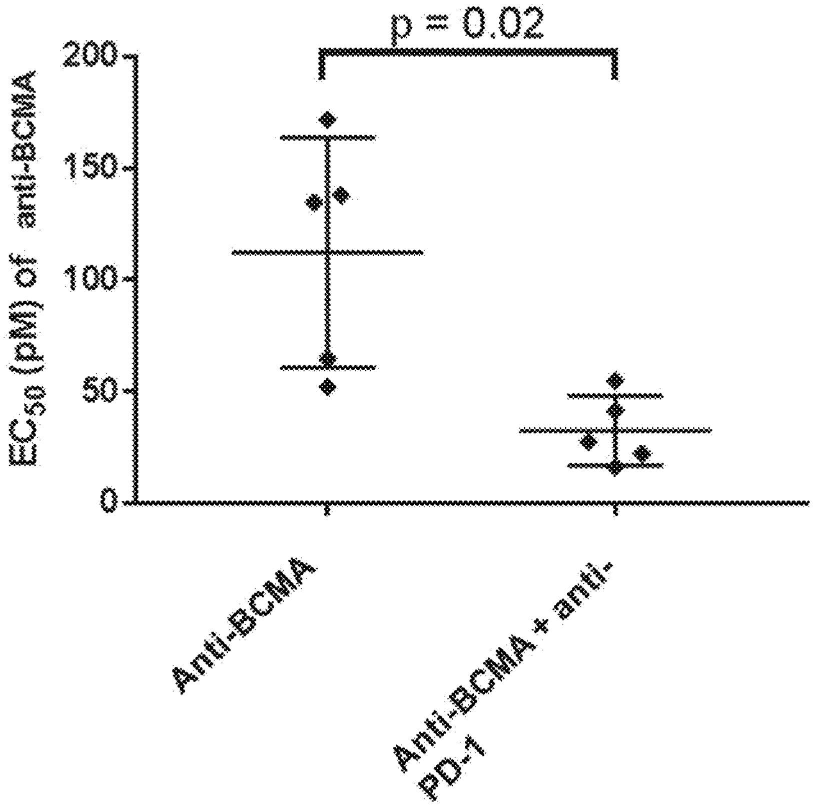
Figure 34B:
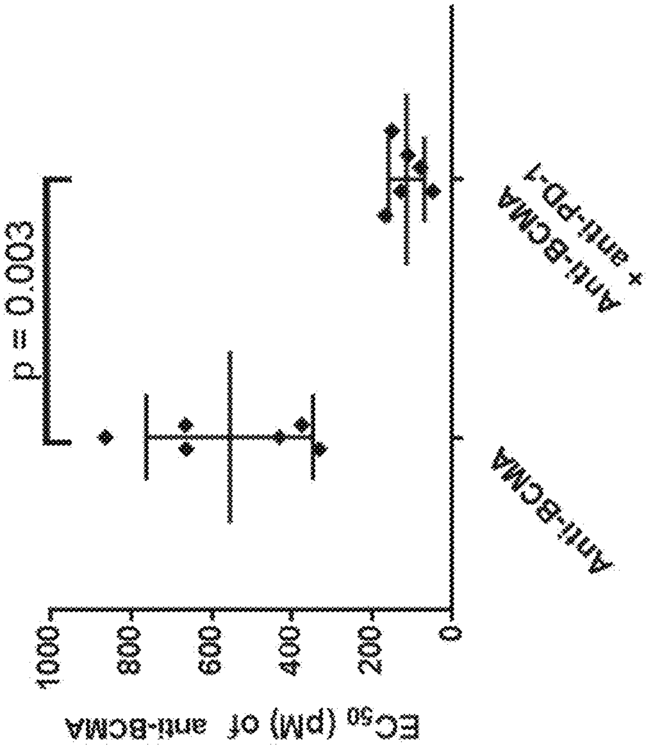
Figure 34A:
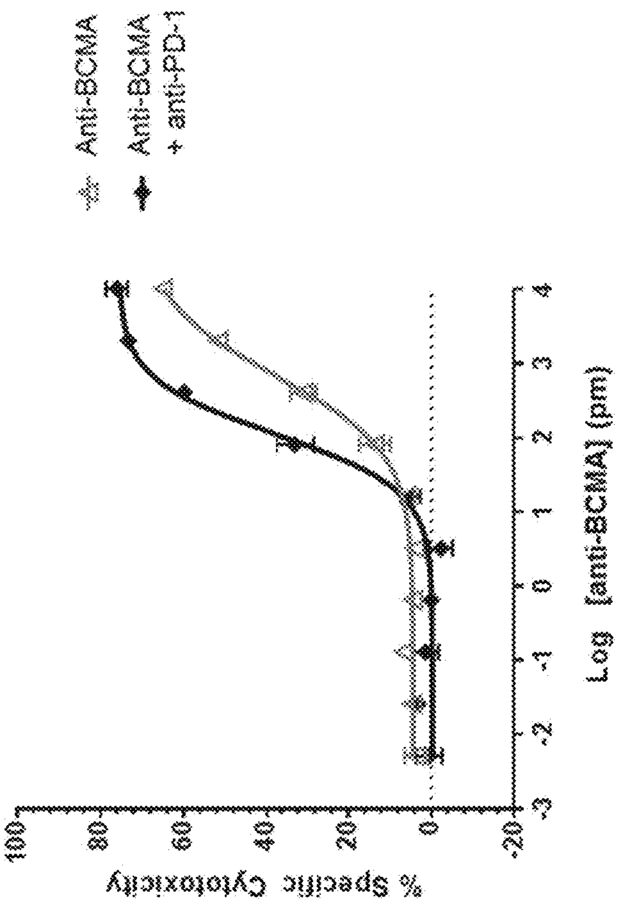
Figure 35A:
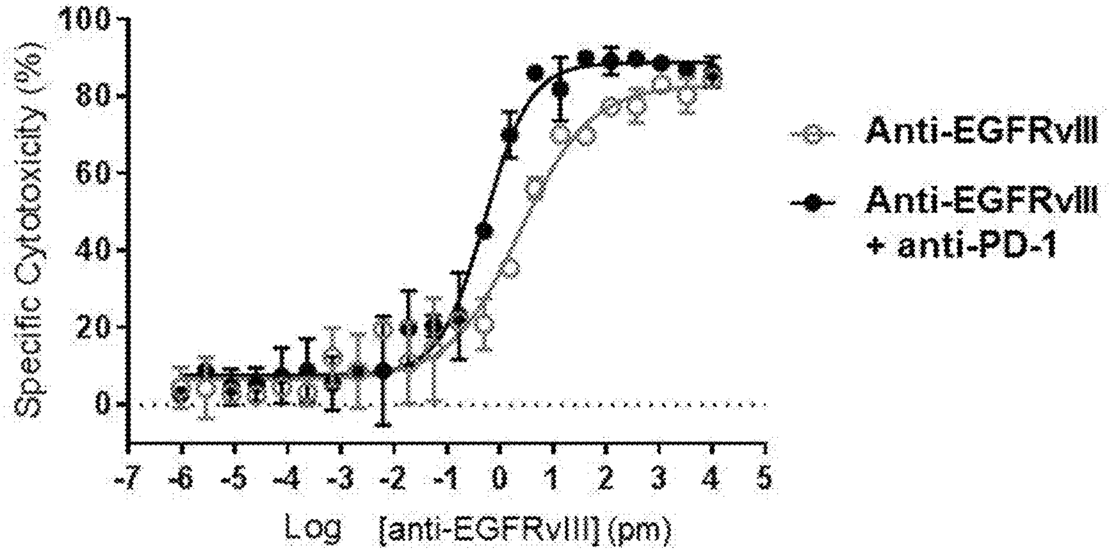
Figure 35B:
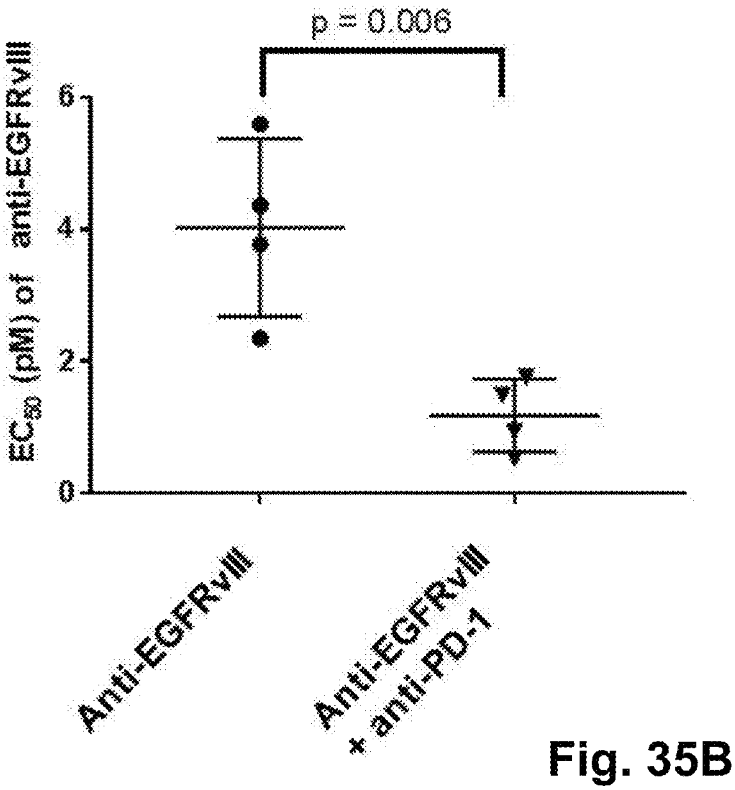
Figure 36B:
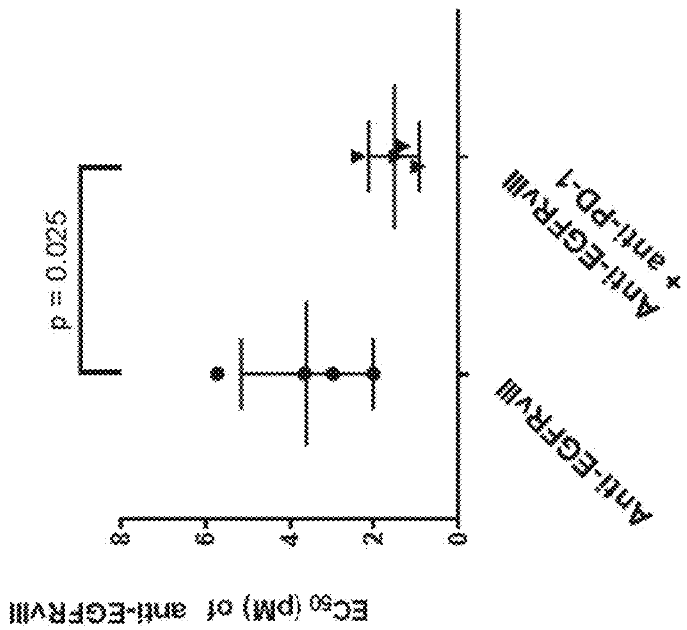
Figure 36A:
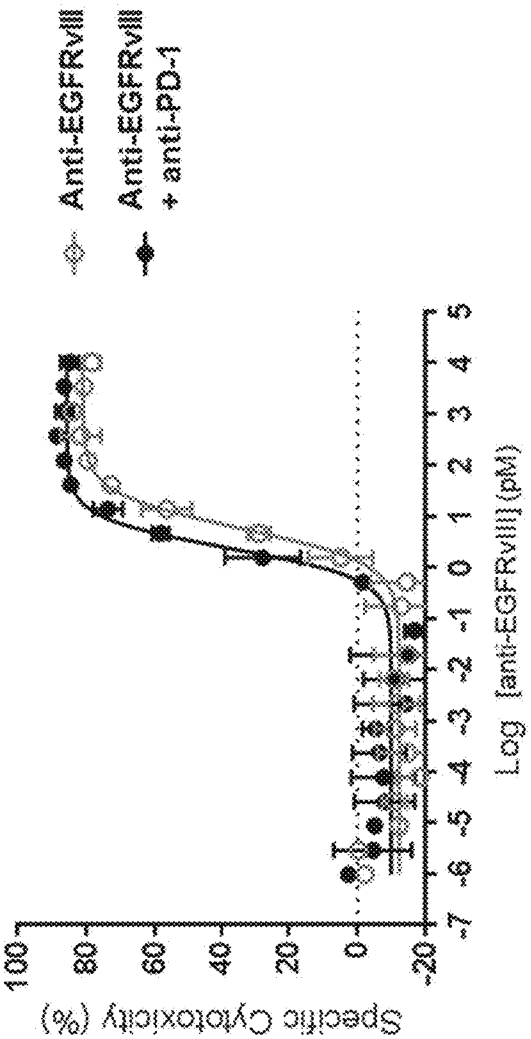
Figure 37A:
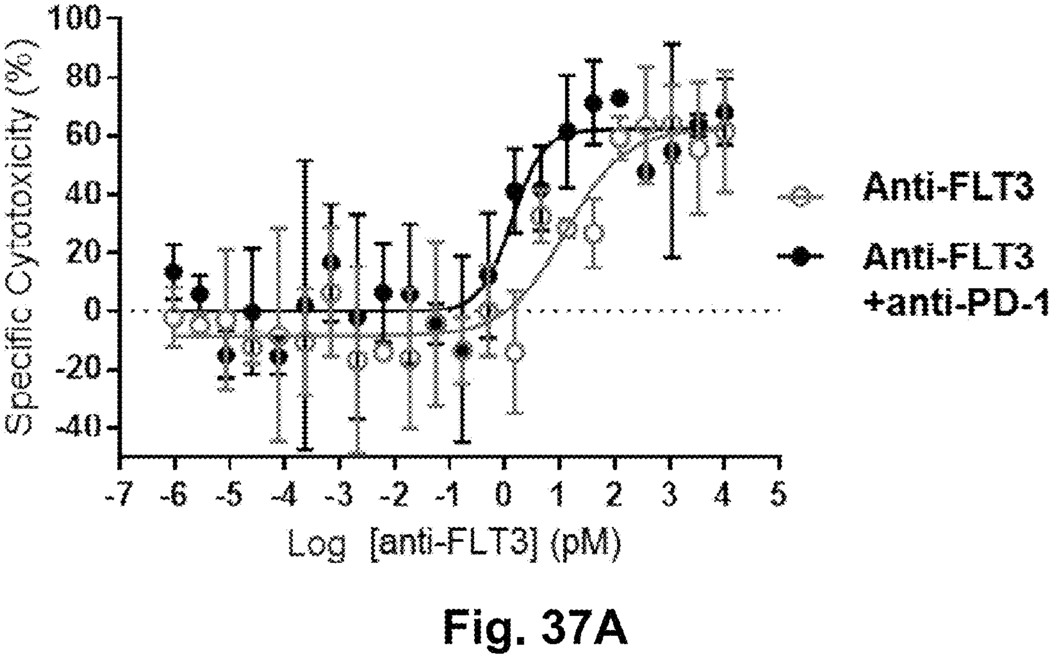
Figure 37B:
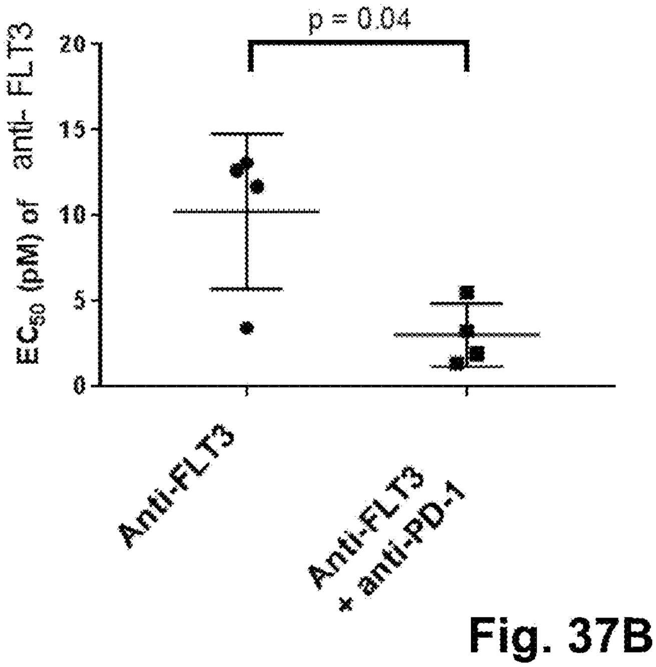
Figure 38A:
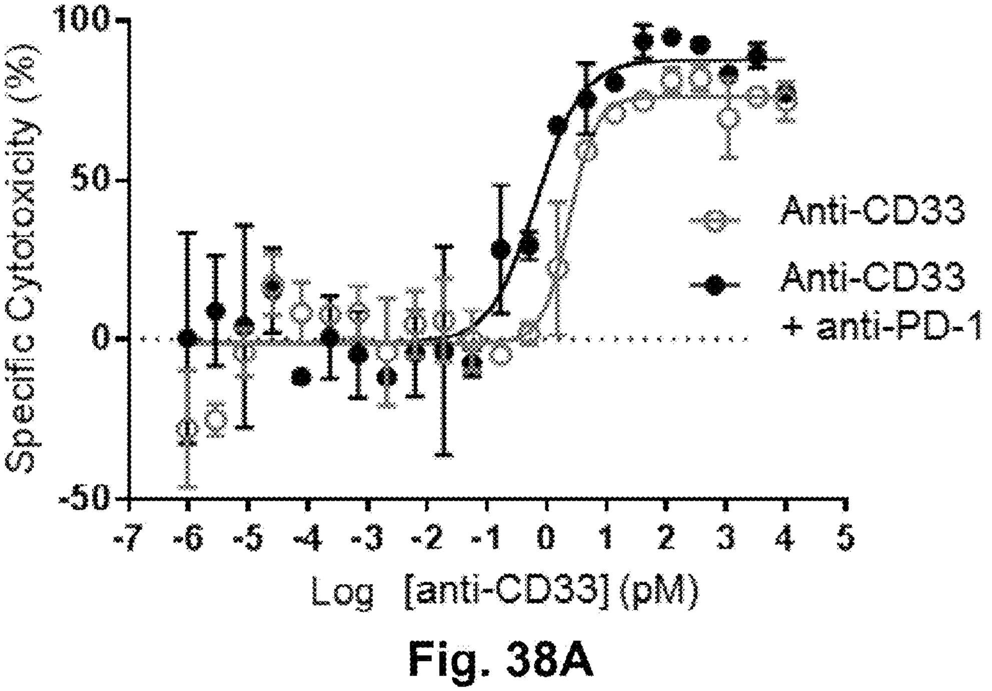
Figure 38B:
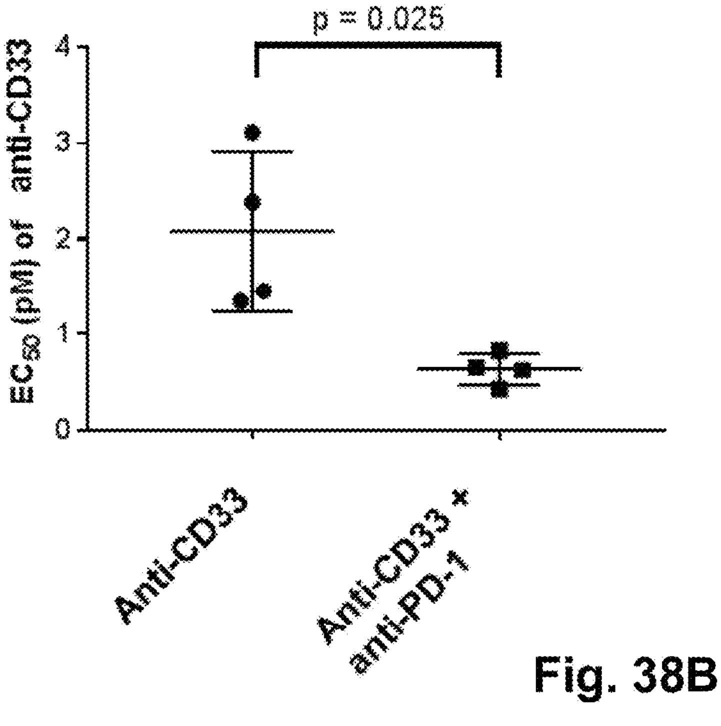
Figure 39A:
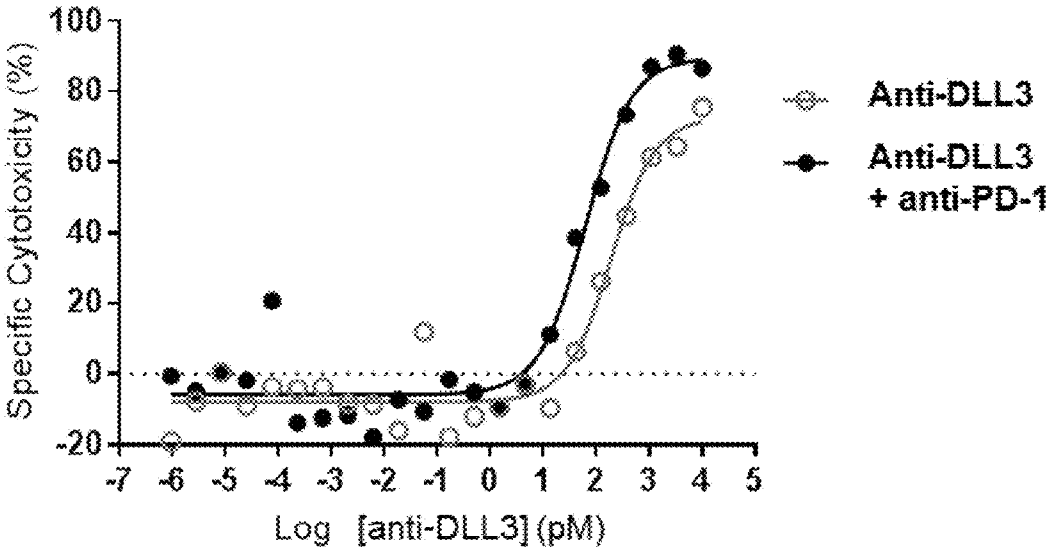
Figure 39B:
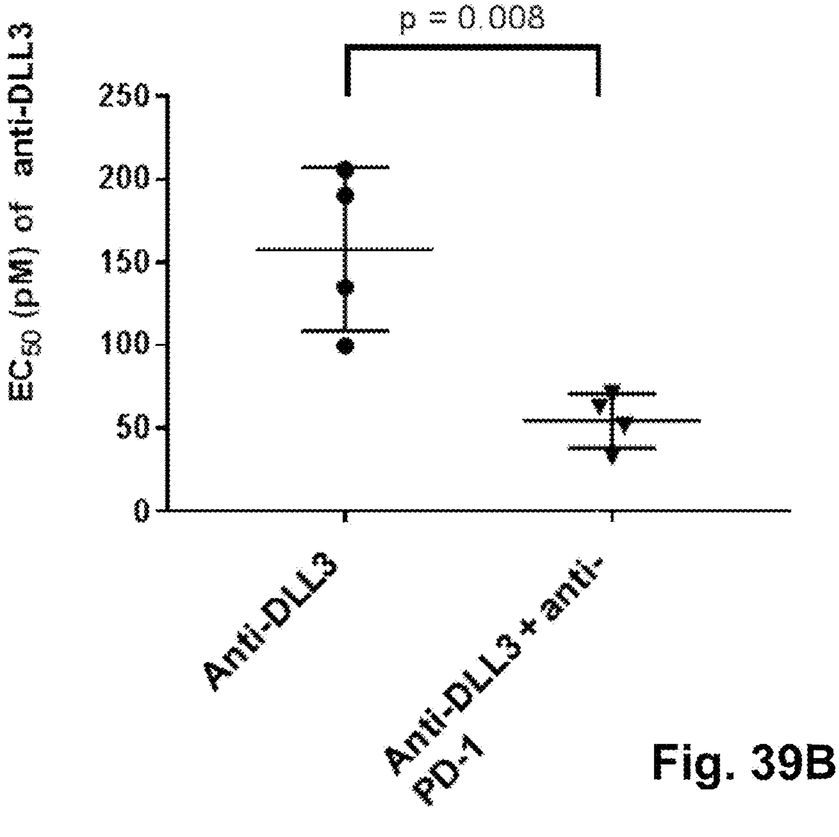
Figure 40A:
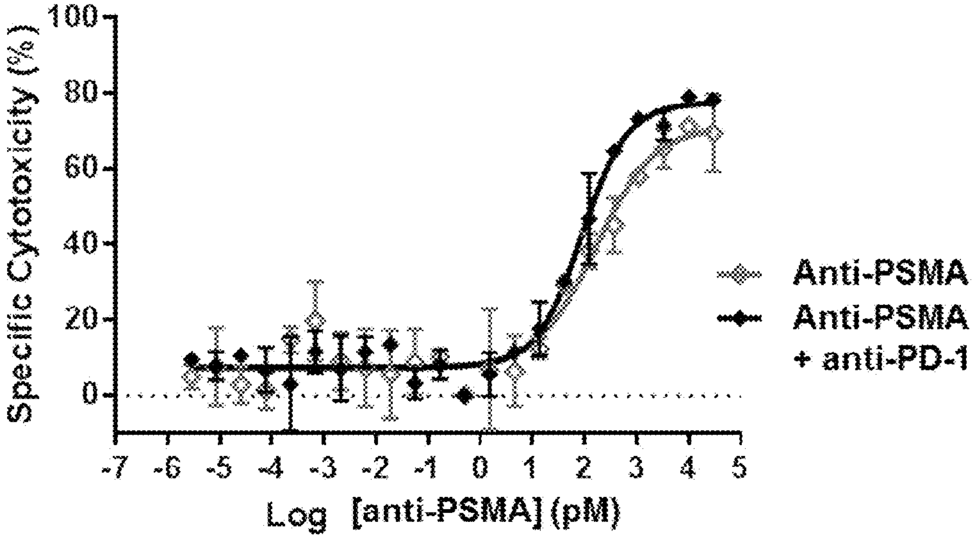
Figure 40B:
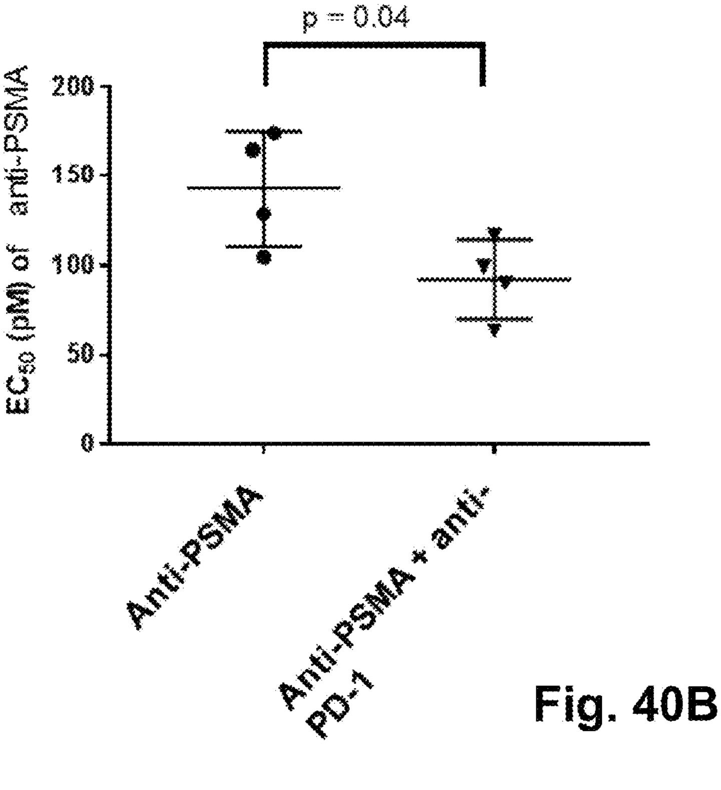
Figure 41A:
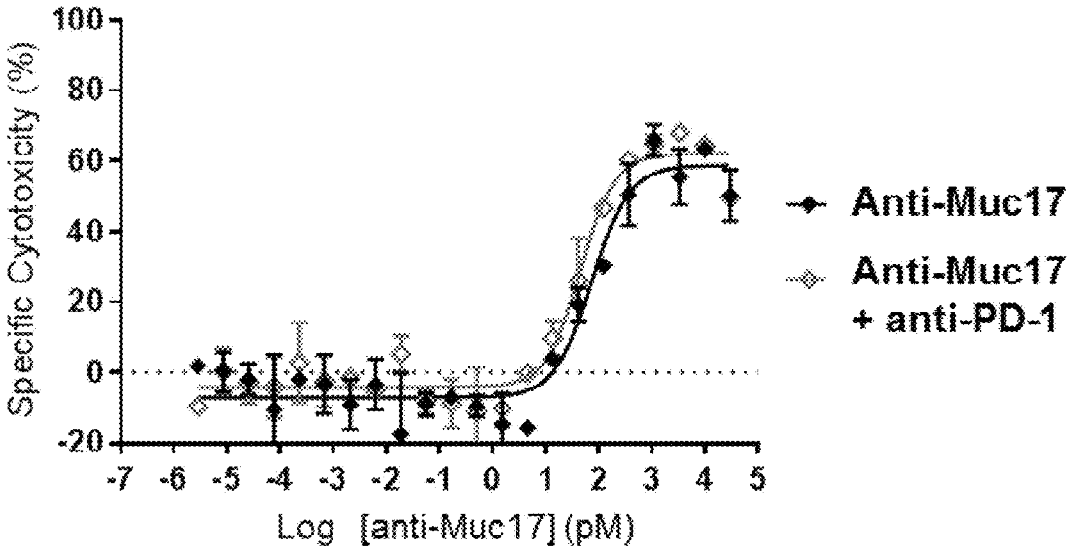
Figure 41B:
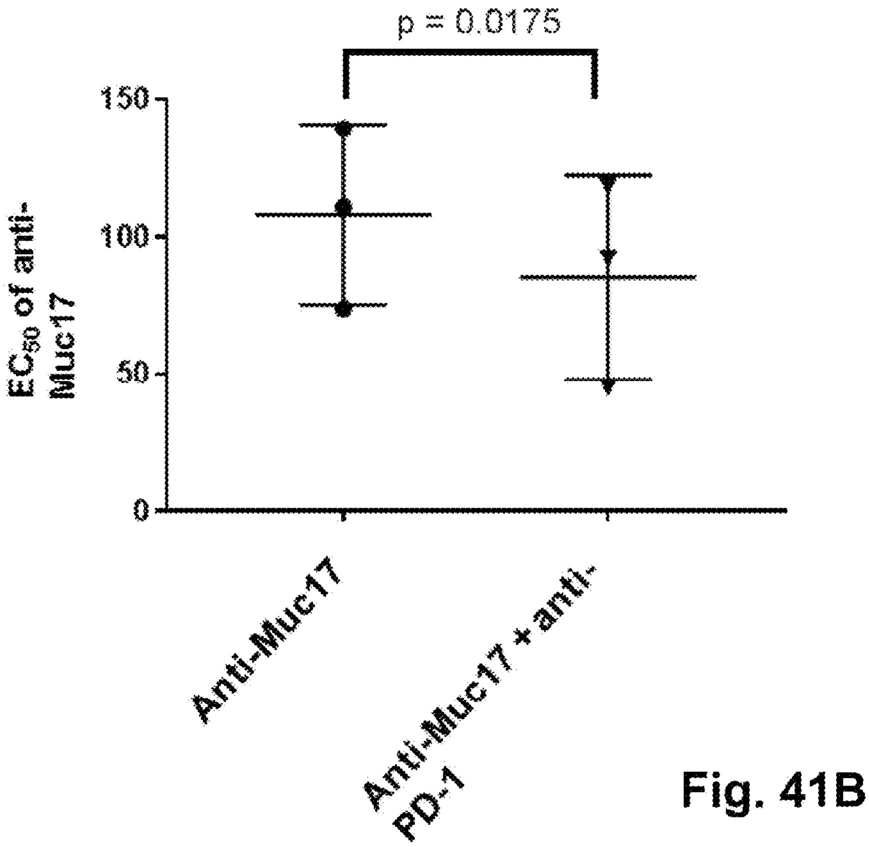

FIGS. 33A-41B show the results of the TDCC assay described in Example 20. Briefly, different PD-L1 overexpressing target cells and human T cells (effector cells) were incubated either with a bispecific anti-CD3×anti-TAA (tumor associated antigen) single chain antibody construct alone, or with the bispecific antibody construct in combination with anti-PD-1 antibody 20C1.009. In all assays, human pan T cells were activated 1:1 with CD3/CD28 beads for 48 hrs, and the TDCC assay was carried out with a effector to target cell (E:T) ratio of 1:1 and over a period of 24 hrs. Each of FIGS. 33A, 34A, 35A, 36A, 37A, 38A, 39A, 40A and 41A is a graph of % specific cytotoxicity plotted as a function of the log concentration of the indicated antibody and shows the data of one representative T cell donor. Each of FIGS. 33B, 34B, 35B, 36B, 37B, 38B, 39B, 40B and-41B is a graph of the EC50 of the indicated antibody for cells incubated with the indicated antibody along or in combination with anti-PD-1 antibody 20C1.009 and show the data of four different T cell donors. Together, the data of FIGS. 33A-41B demonstrate improved killing of target cells with the various bispecific anti-CD3×anti-TAA single chain antibody constructs when they are combined with anti-PD1 antibody 20C1.009. FIGS. 33A and 33B: Target cells: KMS12BM_PD-L1; bispecific antibody construct: SEQ ID NO: 698; TAA: BCMA; analysis via FACS. In FIGS. 34A and 34B: Target cells: U266B1_PD-L1; bispecific antibody construct: SEQ ID NO: 698; TAA: BCMA; analysis via FACS. In FIGS. 35A and 35B: Target cells: U251_EGFRvIII_PD-L1; bispecific antibody construct: SEQ ID NO: 707; TAA: EGFRvIII; analysis via cell titer glo. In FIGS. 36A and 36B: Target cells: U87_EGFRvIII_PD-L1; bispecific antibody construct: SEQ ID NO: 707; TAA: EGFRvIII; analysis via cell titer glo. In FIGS. 37A and 37B: Target cells: MOLM13_PD-L1 bispecific antibody construct: SEQ ID NO: 704; TAA: FLT3; analysis via Luciferase. In FIGS. 38A and 38B: Target cells: MV411_PD-L1; bispecific antibody construct: SEQ ID NO: 715; TAA: CD33; analysis via Luciferase. In FIGS. 39A and 39B: Target cells: SHP77_PD-L1; bispecific antibody construct: SEQ ID NO: 701; TAA: DLL3; analysis via Luciferase. In FIGS. 40A and 40B: Target cells: C42b_luc_PD-L1; bispecific antibody construct: SEQ ID NO: 721; TAA: PSMA; analysis via steady glo. In FIGS. 41A and 41B: Target cells: NUGC4_PD-L1; bispecific antibody construct: SEQ ID NO: 724; TAA: Muc17; analysis via Luciferase.

DETAILED DESCRIPTION

There remains a need for novel immune potentiating approaches that can deploy the immune system against cancer cells in a safe and efficacious manner, especially in light of the fact that current immunotherapy approaches are efficacious in only a minority of patients, and can have significant and often unpredictable toxicities. In one aspect, the novel class of bifunctional fusion molecules comprising a PD-1 targeting antibody that can block PD-1/PD-L1 interaction, fused to an engineered affinity attenuated interleukin-21 mutein disclosed herein addresses this need. The antibody/cytokine fusions described herein overcome significant barriers associated with cytokine therapeutics, allowing for, inter alia, antibody-like dosing and selective delivery of the IL-21 cytokine in a PD-1 targeted manner. When fused to an anti-PD-1 antibody, IL-21 muteins can selectively activate and expand PD-1 expressing T cells in vivo. Accordingly, the antibody/cytokine fusions described herein may improve upon and extend the utility of anti-PD-1 therapeutics currently under testing in the clinic.

The combination of cytokine and co-inhibitory receptor agonists or antagonists remains challenging because of the risks of incremental toxicity and the need for complex clinical trial design (see, e.g., Ott et al., *J Immunother Cancer* 5, 16 (2017); and Hermel et al., *Cancer Metastasis Rev* 36, 43-50 (2017)). With respect to cytokines, there is also the potential for the activation of inhibitory feedback pathways that can lead to immune suppression (see, e.g., Portielje et al, *Clin Cancer Res* 9, 76-83 (2003); Wan et al., *Immunity* 38, 514-527 (2013); and Mooradian et al., *Oncoimmunology* 7, e1423172 (2018)). Interleukin-21 (IL-21) is a type I cytokine and a member of the common cytokine receptor gamma-chain (cg-chain) cytokine family that has emerged as a promising immune therapeutic for the treatment of cancer. IL-21 is produced by activated CD4 T cells and natural killer T (NKT) cells and signals via a heterodimeric receptor complex comprised of a discrete IL-21 receptor (IL-21R) subunit that associates with the common gamma-chain (see, e.g., Spolski et al., *Nat Rev Drug Discov* 13, 379-395 (2014)). Activation of the IL-21R complex leads to the activation of the JAK/STAT signaling pathway. IL-21R is broadly expressed in hematopoietic cells including T and B lymphocytes, natural killer (NK) cells and myeloid cells. Although not an essential growth or differentiation factor, IL-21 is a potent mitogen and survival factor for NK cells and activated T cells. IL-21 can support the differentiation of CD4 (+) T helper 17 (Th17) as well follicular helper T cells (Tfh) and can antagonize regulatory T cell (Treg) differentiation. Moreover, IL-21 can augment the survival of CD8 T cells and preserves a less activated but more persistent T cell phenotype, which allows for enhanced tumor and viral control.

A challenging aspect of cytokine immunotherapy is that, in addition to activating immune cells to potentiate immune responses, the same cytokine can also activate counter-regulatory pathways. For example, IL-2 and IFNγ which can activate protective immune responses as well as regulatory T cell responses and inhibitory pathways (such as PD-L1) respectively. In dendritic cells (DCs), IL-21 can inhibit both DC maturation and activation, can induce the apoptosis of conventional DCs, can potently inhibit the priming of T cells in mixed cultures, and may play a role in the induction of tolerance. In humans, IL-21 has been tested as a non-targeted free cytokine in several cancer indications, but despite the promising preclinical data and early phase I clinical data, development of this approach has not progressed further than phase II testing (see, e.g., Thompson et al., *J Clin Oncol* 26, 2034-2039 (2008); and Davis et al., *Clin Cancer Res* 15, 2123-2129 (2009)). In more recent preclinical models, the combination of recombinant IL-21 cytokine with co-inhibitory receptor antagonists (e.g., anti-CTLA-4 and anti-PD-1) have demonstrated that IL-21 can extend the efficacy of these treatments. Such combinations are now under testing in the clinic, though clinical efficacy has yet to be demonstrated (Lewis et al., *Oncoimmunology* 7, e1377873 (2017)).

Without being bound by a theory, the antibody/cytokine fusions described herein are designed to utilize the immune potentiating activity of IL-21 (which may be prerequisite to address toxicity and off-target immune suppression), to maximize efficacy, and improve the feasibility of dosing in the clinic.

IL-21 and IL-21 Muteins

Interleukin-21 (IL-21) is a cytokine expressed by T cells, B cells, NK cells and myeloid cells, and regulates the activity of both innate and adaptive immune cells and improves T cell survival and effector function. Several Phase I and II clinical trials include IL-21 as the investigational product for the treatment of cancers, inflammatory diseases, and autoimmune diseases, including, melanoma, renal cell carcinoma, acute myeloid leukemia, non-Hodgkin's lymphoma, ovarian cancer, colorectal cancer, systemic lupus erythematosus, Crohn's disease and rheumatoid arthritis.

IL-21 has a four-helix bundle structure and exists as a monomer. In humans, two isoforms of IL-21 are known, each of which are derived from a precursor molecule. The first IL-21 isoform comprises 162 amino acids (aa), the first 29 of which make up the signal peptide; and the second IL-21 isoform comprises 153 aa, the first 29 of which make up the signal peptide as in the first isoform. The amino acid sequences of the first and second IL-21 isoforms (including the signal peptide) are provided herein as SEQ ID NO: 258 and SEQ ID NO: 259, respectively.

IL-21 binds to the heterodimeric IL-21 receptor (IL-21R) expressed on the surface of T, B, and NK cells. IL-21R is similar in structure to the IL-2 receptor and the IL-15 receptor, in that each of these cytokine receptors comprises a common gamma chain (γc). In addition to the γc, the IL-21R comprises an alpha chain which is important for binding to IL-21. There are two isoforms of the human IL-21 receptor alpha chain: isoform 1 and isoform 2. The amino acid sequences of isoform 1 and isoform 2 are provided herein as SEQ ID NOs: 256 and 261, respectively. The amino acid sequence of the human common gamma chain is provided herein as SEQ ID NO: 257.

When IL-21 binds to IL-21R, the Jak/STAT signaling pathway is activated to activate target genes. While IL-21-induced signaling may be therapeutically desirable, careful consideration of the timing and the location of the signaling is needed, given IL-21's broad expression profile and due to the fact that IL-21 has the ability to potentiate CD8 T cell responses as well as to suppress antigen presentation and T cell priming. The data presented herein for the first time supports the use of carefully designed IL-21 muteins to achieve IL-21 signaling at the appropriate time and place.

The present disclosure provides IL-21 muteins comprising at least one amino acid substitution, relative to the wild-type IL-21 amino acid sequence, which is provided herein as SEQ ID NO: 1. For example, the IL-21 mutein comprises at least one and not more than 34 amino acid substitutions. In exemplary aspects, the IL-21 mutein comprises at least one and not more than X amino acid substitutions, wherein X is 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, or 34. In exemplary embodiments, the IL-21 mutein comprises an amino acid sequence which differs from the amino acid sequence of human IL-21 (SEQ ID NO: 1) by no more than 10 amino acids, 15 amino acids, 20 amino acids, or 25 amino acids. In exemplary embodiments, the IL-21 mutein comprises an amino acid sequence which differs from the amino acid sequence of human IL-21 (SEQ ID NO: 1) by no more than 7 amino acids or no more than 5 amino acids. In exemplary embodiments, the IL-21 mutein comprises an amino acid sequence which differs from the amino acid sequence of human IL-21 (SEQ ID NO: 1) by 3, 4, 5, or 6 amino acids. In exemplary embodiments, the IL-21 mutein comprises an amino acid sequence which differs from the amino acid sequence of human IL-21 (SEQ ID NO: 1) by 3 to 6 amino acids or 1 to 5 amino acids. In exemplary embodiments, the IL-21 mutein comprises an amino acid sequence which differs from the amino acid sequence of human IL-21 (SEQ ID NO: 1) by one or two amino acids.

In exemplary aspects, the IL-21 mutein comprises the amino acid sequence of SEQ ID NO: 2, wherein SEQ ID NO: 2 is QGQDX HMXXM XXXXX XVDXL KNXVN DLVPE FLPAP EDVET NCEWS AFSCF QKAQL KSANT GNNEX XIXXX XXXLX XXXXX TNAGR RQKHR LTCPS CDSYE KKPPK EFLXX FXXLL XXMXX QHXSS RTHGS EDS (SEQ ID NO: 2), wherein X represents any amino acid, and wherein the IL-21 mutein amino acid sequence differs from the amino acid sequence of human IL-21 (SEQ ID NO: 1) by at least 1 amino acid.

Thus, in exemplary aspects, the IL-21 mutein comprises the sequence of SEQ ID NO: 2, wherein SEQ ID NO: 2 differs from SEQ ID NO: 1 by at least one amino acid at a position designated by X in SEQ ID NO: 2. In exemplary aspects, the IL-21 mutein comprising SEQ ID NO: 2 has at least about 30%, at least about 40%, at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 1. In exemplary aspects, the IL-21 mutein comprises an amino acid sequence which is at least about 30%, at least about 40%, at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 1.

In exemplary embodiments, the IL-21 mutein comprises an amino acid sequence comprising at least one amino acid substitution relative to the wild-type IL-21 amino acid sequence, and the amino acid substitution(s) occur(s) within the N-terminal half of the amino acid sequence. For example, the amino acid substitution(s) occur(s) at a position within positions 5-25 or 8-23 (both inclusive), according to the amino acid position numbering of SEQ ID NO: 1.

In exemplary embodiments, the IL-21 mutein comprises an amino acid sequence comprising at least one amino acid substitution relative to the wild-type IL-21 amino acid sequence, and the amino acid substitution(s) occur(s) within the C-terminal half of the amino acid sequence. For example, the amino acid substitution(s) occur(s) at a position within positions 100-133 or 109-123 (both inclusive), according to the amino acid position numbering of SEQ ID NO: 1.

In exemplary embodiments, the IL-21 mutein comprises an amino acid sequence comprising at least one amino acid substitution relative to the wild-type IL-21 amino acid sequence, and the amino acid substitution(s) occur(s) in the middle third of the amino acid sequence. For example, the amino acid substitution(s) occur(s) at a position within positions 55-85 or 65-80 (both inclusive), according to the amino acid position numbering of SEQ ID NO: 1.

The present disclosure also provides IL-21 muteins comprising only one amino acid substitution, relative to the wild-type IL-21 amino acid sequence, which is provided herein as SEQ ID NO: 1. In exemplary aspects, the amino acid substitution is located at an amino acid position selected from the group consisting of: 5, 8, 9, 11, 12, 13, 14, 15, 16, 19, 23, 65, 66, 68, 69, 70, 71, 72, 73, 75, 76, 77, 78, 79, 80, 109, 110, 112, 113, 116, 117, 119, 120, or 123, according to the amino acid position numbering of SEQ ID NO: 1. In other exemplary aspects, the amino acid substitution is located at an amino acid position selected from the group consisting of: 5, 8, 9, 11, 12, 13, 14, 15, 16, 19, 23, 65, 66, 68, 69, 70, 72, 73, 75, 76, 77, 78, 79, 80, 109, 110, 112, 113, 116, 117, 119, 120, or 123, according to the amino acid position numbering of SEQ ID NO: 1. In yet other exemplary aspects, the IL-21 mutein comprises any one of the amino acid sequences of SEQ ID NOs: 3-21 and 23-37.

The present disclosure further provides IL-21 muteins comprising only two amino acid substitutions, relative to SEQ ID NO: 1. In exemplary aspects, the amino acid substitutions are located at two amino acid positions selected from the group consisting of: 5, 8, 9, 11, 12, 13, 14, 15, 16, 19, 23, 65, 66, 68, 69, 70, 71, 72, 73, 75, 76, 77, 78, 79, 80, 109, 110, 112, 113, 116, 117, 119, 120, or 123, according to the amino acid position numbering of SEQ ID NO: 1. In other exemplary aspects, the amino acid substitutions are located at two amino acid positions selected from the group consisting of: 5, 9, 15, 70, 71, 72, 73, and 76, according to the amino acid position numbering of SEQ ID NO: 1. In yet other exemplary aspects, the amino acid substitutions are located at two amino acid positions selected from the group consisting of: 5, 9, 73, and 76, according to the amino acid position numbering of SEQ ID NO: 1.

In exemplary aspects, at least one of the two amino acid substitutions is located at position 76, according to the amino acid position numbering of SEQ ID NO: 1. In exemplary aspects, the IL-21 mutein comprises any one of the amino acid sequences of SEQ ID NOs: 199-208 and 210-212.

In exemplary embodiments, the IL-21 mutein comprises an amino acid sequence comprising at least one amino acid substitution relative to the wild-type IL-21 amino acid sequence, and the amino acid substitution(s) is/are conservative amino acid substitution(s). As used herein, the term "conservative amino acid substitution" refers to the substitution of one amino acid with another amino acid having similar properties, e.g., size, charge, hydrophobicity, hydrophilicity, and/or aromaticity, and includes exchanges within one of the following five groups:

I. Small aliphatic, nonpolar or slightly polar residues: Ala, Ser, Thr, Pro, Gly;
II. Polar, negatively charged residues and their amides and esters: Asp, Asn, Glu, Gln, cysteic acid and homocysteic acid;
III. Polar, positively charged residues: His, Arg, Lys; Ornithine (Orn)
IV. Large, aliphatic, nonpolar residues: Met, Leu, Ile, Val, Cys, Norleucine (Nle), homocysteine
V. Large, aromatic residues: Phe, Tyr, Trp, acetyl phenylalanine.

In exemplary embodiments, the IL-21 mutein comprises an amino acid sequence comprising at least one amino acid substitution relative to the wild-type IL-21 amino acid sequence, and the amino acid substitution(s) is/are non-conservative amino acid substitution(s). As used herein, the term "non-conservative amino acid substitution" is defined herein as the substitution of one amino acid with another amino acid having different properties, e.g., size, charge, hydrophobicity, hydrophilicity, and/or aromaticity, and includes exchanges outside the above five groups.

In exemplary aspects, the IL-21 mutein comprises an amino acid sequence comprising at least one amino acid substitution relative to the wild-type IL-21 amino acid sequence, and the substitute amino acid is a naturally-occurring amino acid. By "naturally-occurring amino acid" or "standard amino acid" or "canonical amino acid" is meant one of the 20 alpha amino acids found in eukaryotes encoded directly by the codons of the universal genetic code (Ala, Val, Ile, Leu, Met, Phe, Tyr, Trp, Ser, Thr, Asn, Gln, Cys, Gly, Pro, Arg, His, Lys, Asp, Glu). In exemplary aspects, the IL-21 mutein comprises an amino acid sequence comprising at least one amino acid substitution relative to the wild-type IL-21 amino acid sequence, and the substitute amino acid is a non-standard amino acid, or an amino acid which is not incorporated into proteins during translation. Non-standard amino acids include, but are not limited to: selenocysteine, pyrrolysine, ornithine, norleucine, α-amino acids (e.g., β-alanine, β-aminoisobutyric acid, β-phenlyalanine, β-homophenylalanine, β-glutamic acid, β-glutamine, β-homotryptophan, β-leucine, β-lysine), homo-amino acids (e.g., homophenylalanine, homoserine, homoarginine, monocysteine, homocystine), N-methyl amino acids (e.g., L-abrine, N-methyl-alanine, N-methyl-isoleucine, N-methyl-leucine), 2-aminocaprylic acid, 7-aminocephalosporanic acid, 4-aminocinnamic acid, alpha-aminocyclohexanepropionic acid, amino-(4-hydroxyphenyl)acetic acid, 4-amino-nicotinic acid, 3-aminophenylacetic acid, and the like.

In exemplary aspects, the IL-21 mutein of the present disclosure comprises an amino acid sequence with at least one amino acid substitution relative to the amino acid sequence of human IL-21 (SEQ ID NO: 1), the amino acid substitution is at one or more of positions 5, 8, 9, 12, 14, 15, 65, 66, 69, 70, 72, 73, 75, 76, 77, 80, 116, and 119 of SEQ ID NO: 1, and the substitute amino acid(s) is/are aliphatic amino acids. In exemplary aspects, the IL-21 mutein of the present disclosure comprises an amino acid sequence with only one amino acid substitution, relative to SEQ ID NO: 1, the amino acid substitution is at position 5, 8, 9, 12, 14, 15, 65, 66, 69, 70, 72, 73, 75, 76, 77, 80, 116, or 119 of SEQ ID NO: 1, and the substitute amino acid is an aliphatic amino acid.

In exemplary aspects, the IL-21 mutein of the present disclosure comprises an amino acid sequence with at least one amino acid substitution relative to the amino acid sequence of human IL-21 (SEQ ID NO: 1), the amino acid substitution is at one or more of positions 5, 8, 9, 11, 12, 13, 14, 15, 16, 19, 23, 65, 66, 69, 70, 72, 73, 75, 76, 77, 78, 79, 110, 112, 116, 117, 119, 120, or 123 of SEQ ID NO: 1, and the substitute amino acid(s) is/are acidic amino acids. In exemplary aspects, the IL-21 mutein of the present disclosure comprises an amino acid sequence with only one amino acid substitution, relative to SEQ ID NO: 1, the amino acid substitution is at position 5, 8, 9, 11, 12, 13, 14, 15, 16, 19, 23, 65, 66, 69, 70, 72, 73, 75, 76, 77, 78, 79, 110, 112, 116, 117, 119, 120, or 123 of SEQ ID NO: 1, and the substitute amino acid is an acidic amino acid.

In exemplary aspects, the IL-21 mutein of the present disclosure comprises an amino acid sequence with at least one amino acid substitution relative to the amino acid sequence of human IL-21 (SEQ ID NO: 1), the amino acid substitution is at one or more of positions 5, 9, 73, 76, 109, 113, or 116 of SEQ ID NO: 1, and the substitute amino acid(s) is/are basic amino acids. In exemplary aspects, the IL-21 mutein of the present disclosure comprises an amino acid sequence with only one amino acid substitution, relative to SEQ ID NO: 1, and the amino acid at position 5, 9, 73, 76, 109, 113, or 116 of SEQ ID NO: 1 is a basic amino acid.

In exemplary aspects, the IL-21 mutein of the present disclosure comprises an amino acid sequence with at least one amino acid substitution relative to the amino acid sequence of human IL-21 (SEQ ID NO: 1), the amino acid substitution is at one or more of positions 5, 8, 9, 70, or 76 of SEQ ID NO: 1, and the substitute amino acid(s) is/are aromatic amino acids. In exemplary aspects, the IL-21 mutein of the present disclosure comprises an amino acid sequence with only one amino acid substitution, relative to SEQ ID NO: 1, the amino acid substitution is at position 5, 8, 9, 70, or 76 of SEQ ID NO: 1, and the substitute amino acid is an aromatic amino acid.

In exemplary aspects, the IL-21 mutein of the present disclosure comprises an amino acid sequence with at least one amino acid substitution relative to the amino acid sequence of human IL-21 (SEQ ID NO: 1), the amino acid substitution is at one or more of positions 5, 8, 9, 12, 15, 73, 76, 116, or 119 of SEQ ID NO: 1, and the substitute amino acid(s) is/are amino acids comprising a side chain amide. In exemplary aspects, the IL-21 mutein of the present disclosure comprises an amino acid sequence with only one amino acid substitution, relative to SEQ ID NO: 1, the amino acid substitution is at position 5, 8, 9, 12, 15, 73, 76, 116, or 119 of SEQ ID NO: 1, and the substitute amino acid is an amino acid comprising a side chain amide.

In exemplary aspects, the IL-21 mutein of the present disclosure comprises an amino acid sequence with at least one amino acid substitution relative to the amino acid sequence of human IL-21 (SEQ ID NO: 1), the amino acid substitution is at one or more of positions 5, 8, 9, 11, 12, 14, 15, 73, 76, 116, or 119 of SEQ ID NO: 1, and the substitute amino acid(s) is/are amino acids comprising a side chain hydroxyl. In exemplary aspects, the IL-21 mutein of the present disclosure comprises an amino acid sequence with only one amino acid substitution, relative to SEQ ID NO: 1, the amino acid substitution is at position 5, 8, 9, 11, 12, 14, 15, 73, 76, 116, or 119 of SEQ ID NO: 1, and the substitute amino acid is an amino acid comprising a side chain hydroxyl.

In exemplary aspects, the IL-21 mutein of the present disclosure comprises an amino acid sequence with at least one amino acid substitution relative to the amino acid sequence of human IL-21 (SEQ ID NO: 1), the amino acid substitution is at one or more of positions 65, 66, 69, 70, 72, 73, 75, 76, 77, or 80 of SEQ ID NO: 1, and the substitute amino acid(s) is/are imino acids. In exemplary aspects, the IL-21 mutein of the present disclosure comprises an amino acid sequence with only one amino acid substitution, relative to SEQ ID NO: 1, the amino acid substitution is at position 65, 66, 69, 70, 72, 73, 75, 76, 77, or 80 of SEQ ID NO: 1, and the substitute amino acid is an amino acid comprising an imino acid.

In exemplary aspects, the IL-21 mutein of the present disclosure comprises an amino acid sequence with at least one amino acid substitution relative to the amino acid sequence of human IL-21 (SEQ ID NO: 1), the amino acid substitution at one or more of positions 5, 9, 15, 76, 116, or 119 of SEQ ID NO: 1, and the substitute amino acid(s) is/are amino acids comprising a sulfur-containing side chain.

In exemplary aspects, the IL-21 mutein of the present disclosure comprises an amino acid sequence with only one amino acid substitution, relative to SEQ ID NO: 1, the amino acid substitution is at position 5, 9, 15, 76, 116, or 119 of SEQ ID NO: 1, and the substitute amino acid is an amino acid comprising an amino acid comprising a sulfur-containing side chain.

In exemplary aspects, the IL-21 mutein of the present disclosure comprises an amino acid sequence with at least one amino acid substitution, relative to the amino acid sequence of human IL-21 (SEQ ID NO: 1), wherein the at least one amino acid substitution is shown in Table A.

TABLE A

| Amino Acid position of SEQ ID NO: 1 | Examples of Substitute Amino Acids (in single letter code) | Exemplary SEQ ID NO: |
|---|---|---|
| 5 | A, D, E, G, H, I, K, L, M, N, Q, S, T, V, Y | 38 |
| 8 | A, D, E, G, N, S | 39 |
| 9 | A, D, E, G, H, I, K, L, M, N, Q, S, T, V, Y | 40 |
| 11 | D, S | 41 |
| 12 | A, D, E, N, S, T, V | 42 |
| 13 | D | 43 |
| 14 | A, D, S | 44 |
| 15 | A, E, I, M, N, Q, S, T, V | 45 |
| 16 | D, E | 46 |
| 19 | D | 47 |
| 23 | D | 48 |
| 65 | D, G, P | 49 |
| 66 | D, G, P | 50 |
| 68 | Q | 51 |
| 69 | D, G, P | 52 |
| 70 | E, G, P, Y, T | 53 |
| 71 | L | 54 |
| 72 | A, D, G, P | 55 |
| 73 | A, D, E, G, H, I, N, P, Q, S, V | 56 |
| 75 | D, G, P | 58 |
| 76 | A, D, E, G, H, I, K, L, M, N, P, Q, S, T, V, Y | 59 |
| 77 | D, G, P | 60 |
| 78 | D | 61 |
| 79 | D | 62 |
| 80 | G, P | 63 |
| 109 | K | 64 |
| 110 | D | 65 |
| 112 | D | 66 |
| 113 | K | 67 |
| 116 | A, D, E, I, K, L, M, N, S, T, V | 68 |
| 117 | D | 69 |
| 119 | A, D, E, M, N, Q, S, T | 70 |
| 120 | D | 71 |
| 123 | D | 72 |

In exemplary aspects, the IL-21 mutein of the present disclosure comprises an amino acid sequence with only one amino acid substitution, relative to SEQ ID NO: 1, and the amino acid substitution is one shown in Table A. In other embodiments, the IL-21 mutein of the present disclosure comprises an amino acid sequence with two amino acid substitutions, relative to SEQ ID NO: 1, and the amino acid substitutions are two of those shown in Table A.

In exemplary aspects, the IL-21 mutein of the present disclosure comprises an amino acid sequence shown in Table B.

TABLE B

| Amino Acid Substitution | Amino Acid position of SEQ ID NO: 1 | Substitute Amino Acid | SEQ ID NO: |
|---|---|---|---|
| R5A | 5 | A | 73 |
| R5D | 5 | D | 74 |

TABLE B-continued

| Amino Acid Substitution | Amino Acid position of SEQ ID NO: 1 | Substitute Amino Acid | SEQ ID NO: |
|---|---|---|---|
| R5E | 5 | E | 75 |
| R5G | 5 | G | 76 |
| R5H | 5 | H | 77 |
| R5I | 5 | I | 78 |
| R5K | 5 | K | 79 |
| R5L | 5 | L | 80 |
| R5M | 5 | M | 81 |
| R5N | 5 | N | 82 |
| R5Q | 5 | Q | 83 |
| R5S | 5 | S | 84 |
| R5T | 5 | T | 85 |
| R5V | 5 | V | 86 |
| R5Y | 5 | Y | 87 |
| I8A | 8 | A | 88 |
| I8D | 8 | D | 89 |
| I8E | 8 | E | 90 |
| I8G | 8 | G | 91 |
| I8N | 8 | N | 92 |
| I8S | 8 | S | 93 |
| R9A | 9 | A | 94 |
| R9D | 9 | D | 95 |
| R9E | 9 | E | 96 |
| R9G | 9 | G | 97 |
| R9H | 9 | H | 98 |
| R9I | 9 | I | 99 |
| R9K | 9 | K | 100 |
| R9L | 9 | L | 101 |
| R9M | 9 | M | 102 |
| R9N | 9 | N | 103 |
| R9Q | 9 | Q | 104 |
| R9S | 9 | S | 105 |
| R9T | 9 | T | 106 |
| R9V | 9 | V | 107 |
| R9Y | 9 | Y | 108 |
| R11D | 11 | D | 109 |
| R11S | 11 | S | 110 |
| Q12A | 12 | A | 111 |
| Q12D | 12 | D | 249 |
| Q12E | 12 | E | 250 |
| Q12N | 12 | N | 251 |
| Q12S | 12 | S | 252 |
| Q12T | 12 | T | 253 |
| Q12V | 12 | V | 254 |
| L13D | 13 | D | 112 |
| I14A | 14 | A | 114 |
| I14D | 14 | D | 115 |
| I14S | 14 | S | 116 |
| D15A | 15 | A | 117 |
| D15E | 15 | E | 118 |
| D15I | 15 | I | 119 |
| D15M | 15 | M | 120 |
| D15N | 15 | N | 121 |
| D15Q | 15 | Q | 122 |
| D15S | 15 | S | 123 |
| D15T | 15 | T | 283 |
| D15V | 15 | V | 124 |
| I16D | 16 | D | 125 |
| I16E | 16 | E | 126 |
| Q19D | 19 | D | 47 |
| Y23D | 23 | D | 48 |
| R65D | 65 | D | 127 |
| R65G | 65 | G | 128 |
| R65P | 65 | P | 129 |
| I66D | 66 | D | 130 |
| I66G | 66 | G | 131 |
| I66P | 66 | P | 132 |
| N68Q | 68 | Q | 51 |
| V69D | 69 | D | 133 |
| V69G | 69 | G | 134 |
| V69P | 69 | P | 135 |
| S70E | 70 | E | 136 |
| S70G | 70 | G | 137 |
| S70P | 70 | P | 138 |

TABLE B-continued

| Amino Acid Substitution | Amino Acid position of SEQ ID NO: 1 | Substitute Amino Acid | SEQ ID NO: |
|---|---|---|---|
| S70Y | 70 | Y | 139 |
| S70T | 70 | T | 140 |
| K72D | 72 | D | 141 |
| K72G | 72 | G | 142 |
| K72P | 72 | P | 143 |
| K72A | 72 | A | 144 |
| K73A | 73 | A | 145 |
| K73D | 73 | D | 146 |
| K73E | 73 | E | 147 |
| K73G | 73 | G | 148 |
| K73H | 73 | H | 149 |
| K73I | 73 | I | 150 |
| K73N | 73 | N | 151 |
| K73P | 73 | P | 152 |
| K73Q | 73 | Q | 153 |
| K73S | 73 | S | 154 |
| K73V | 73 | V | 155 |
| K75D | 75 | D | 156 |
| K75G | 75 | G | 157 |
| K75P | 75 | P | 158 |
| R76A | 76 | A | 159 |
| R76D | 76 | D | 160 |
| R76E | 76 | E | 161 |
| R76G | 76 | G | 162 |
| R76H | 76 | H | 163 |
| R76I | 76 | I | 164 |
| R76K | 76 | K | 165 |
| R76L | 76 | L | 166 |
| R76M | 76 | M | 167 |
| R76N | 76 | N | 168 |
| R76P | 76 | P | 169 |
| R76Q | 76 | Q | 170 |
| R76S | 76 | S | 171 |
| R76T | 76 | T | 172 |
| R76V | 76 | V | 173 |
| R76Y | 76 | Y | 174 |
| K77D | 77 | D | 175 |
| K77G | 77 | G | 176 |
| K77P | 77 | P | 177 |
| P78D | 78 | D | 61 |
| P79D | 79 | D | 62 |
| S80G | 80 | G | 178 |
| S80P | 80 | P | 179 |
| E109K | 109 | K | 64 |
| R110D | 110 | D | 65 |
| K112D | 112 | D | 66 |
| S113K | 113 | K | 67 |
| Q116A | 116 | A | 180 |
| Q116D | 116 | D | 181 |
| Q116E | 116 | E | 182 |
| Q116I | 116 | I | 183 |
| Q116K | 116 | K | 184 |
| Q116L | 116 | L | 185 |
| Q116M | 116 | M | 186 |
| Q116N | 116 | N | 187 |
| Q116S | 116 | S | 188 |
| Q116T | 116 | T | 189 |
| Q116V | 116 | V | 190 |
| K117D | 117 | D | 69 |
| I119A | 119 | A | 191 |
| I119D | 119 | D | 192 |
| I119E | 119 | E | 193 |
| I119M | 119 | M | 194 |
| I119N | 119 | N | 195 |
| I119Q | 119 | Q | 196 |
| I119S | 119 | S | 197 |
| I119T | 119 | T | 198 |
| H120D | 120 | D | 71 |
| L123D | 123 | D | 72 |

In exemplary embodiments, the IL-21 mutein of the present disclosure comprises an amino acid sequence of any one of SEQ ID NOs: 47, 48, 51, 61, 62, 64-67, 69, 71-112, 114-198, 249-254, or 283. In exemplary aspects, the IL-21 mutein comprises an amino acid sequence which is at least at least about 30%, at least about 40%, at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to one of SEQ ID NOs: 47, 48, 51, 61, 62, 64-67, 69, 71-112, 114-198, 249-254, or 283.

The present disclosure further provides IL-21 muteins comprising only two amino acid substitutions, relative to SEQ ID NO: 1, and the two amino acid substitutions occur at two of positions 5, 9, 15, 70, 71, 72, 73, and 76 of SEQ ID NO: 1. In exemplary aspects, the IL-21 mutein comprises only two amino acid substitutions, relative to SEQ ID NO: 1, and the two substitutions occur at a pair of amino acid positions selected from the group consisting of: 5 and 76; 9 and 76; 15 and 70; 15 and 71; 15 and 72; 15 and 73; 70 and 73; 70 and 76; 71 and 73; 71 and 76; 72 and 73; 72 and 76; and 73 and 76. In exemplary aspects, the IL-21 comprises any one of the amino acid sequences of SEQ ID NOs: 199-208 and 210-212. In other aspects, the present disclosure further provides IL-21 muteins comprising only two amino acid substitutions, relative to SEQ ID NO: 1, and the two amino acid substitutions occur at two of positions 5, 9, 73, and 76 or SEQ ID NO: 1. In exemplary aspects, one of the substitutions occurs at position 76 of SEQ ID NO: 1. In exemplary aspects, the substitute amino acid at position 76 of SEQ ID NO: 1 is an aliphatic amino acid or an acidic amino acid. In exemplary aspects, the aliphatic amino acid is alanine. In exemplary aspects, the acidic amino acid is aspartic acid or glutamic acid. In exemplary aspects, the acidic amino acid is glutamic acid. In exemplary aspects, the IL-21 mutein comprises a substitute amino acid at position 76 and an aliphatic amino acid or acidic amino acid at position 5, 9, or 73 of SEQ ID NO: 1. In exemplary aspects, the substitute amino acid at position 5, 9, or 73 is an aliphatic amino acid, an acidic amino acid, or an amino acid with a side chain amide. In exemplary aspects, the aliphatic amino acid is alanine, the acidic amino acid is glutamic acid, and the amino acid with a side chain amide is glutamine. In exemplary aspects, the IL-21 mutein comprises a substitute amino acid at position 76 of SEQ ID NO: 1 (optionally, an aliphatic amino acid or an acidic amino acid) and a substitute amino acid at position 5 or 9 (according to the numbering of SEQ ID NO: 1).

In exemplary aspects, the IL-21 mutein of the present disclosure comprises an amino acid sequence of any one of the SEQ ID NOs: shown in Table C.

TABLE C

| Amino Acid Substitutions | 1st Amino Acid position of SEQ ID NO: 1 | 1st Substitute Amino Acid | 2nd Amino Acid position of SEQ ID NO: 1 | 2nd Substitute Amino Acid | SEQ ID NO: |
|---|---|---|---|---|---|
| R5E, R76E | 5 | E | 76 | E | 239 |
| R5E, R76A | 5 | E | 76 | A | 238 |
| R5A, R76A | 5 | A | 76 | A | 236 |
| R5Q, R76A | 5 | Q | 76 | A | 240 |
| R5A, R76E | 5 | A | 76 | E | 237 |
| R5Q, R76E | 5 | Q | 76 | E | 241 |
| R9E, R76E | 9 | E | 76 | E | 245 |
| R9A, R76E | 9 | A | 76 | E | 243 |
| R9E, R76A | 9 | E | 76 | A | 244 |
| R9A, R76A | 9 | A | 76 | A | 242 |
| D15N, S70T | 15 | N | 70 | T | 213 |

TABLE C-continued

| Amino Acid Substitutions | 1st Amino Acid position of SEQ ID NO: 1 | 1st Substitute Amino Acid | 2nd Amino Acid position of SEQ ID NO: 1 | 2nd Substitute Amino Acid | SEQ ID NO: |
|---|---|---|---|---|---|
| D15N, I71L | 15 | N | 71 | L | 214 |
| D15N, K72A | 15 | N | 72 | A | 215 |
| D15N, K73A | 15 | N | 73 | A | 216 |
| S70T, K73Q | 70 | T | 73 | Q | 219 |
| S70T, R76A | 70 | T | 76 | A | 246 |
| S70T, R76D | 70 | T | 76 | D | 247 |
| S70T, R76E | 70 | T | 76 | E | 248 |
| I71L, K73Q | 71 | L | 73 | Q | 217 |
| I71L, R76A | 71 | L | 76 | A | 227 |
| I71L, R76D | 71 | L | 76 | D | 228 |
| I71L, R76E | 71 | L | 76 | E | 229 |
| K72A, K73Q | 72 | A | 73 | Q | 218 |
| K72A, R76A | 72 | A | 76 | A | 230 |
| K72A, R76D | 72 | A | 76 | D | 231 |
| K72A, R76E | 72 | A | 76 | E | 232 |
| K73A, R76A | 73 | A | 76 | A | 233 |
| K73A, R76D | 73 | A | 76 | D | 234 |
| K73A, R76E | 73 | A | 76 | E | 235 |

In exemplary aspects, the IL-21 mutein comprises an amino acid sequence selected from the group consisting of SEQ ID NOs: 213-219 and 227-248. In exemplary aspects, the IL-21 comprises an amino acid sequence which is at least at least about 30%, at least about 40%, at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to one of SEQ ID NOs: 213-219 and 227-248.

Peptide Length

The IL-21 muteins described herein may comprise a peptide backbone of any number of amino acids, i.e., can be of any peptide length. In some embodiments, the peptides described herein are the about same length as SEQ ID NO: 1, i.e., are 133 (±about 1 to about 20, ±about 1 to about 15, ±about 1 to about 10, or ±about 1 to about 5) amino acids in length. In some embodiments, the presently disclosed peptide is longer than 133 amino acids in length by virtue of being fused to another polypeptide chain, e.g., an antibody heavy chain comprising about 400 to about 600 amino acids, an antibody light chain comprising about 150 to about 300 amino acids, as further described herein.

Additional Peptide Modifications

In alternative or additional embodiments of the present disclosure, the IL-21 mutein is lipidated (e.g., myritoylated, palmitoylated), glycosylated, amidated, carboxylated, phosphorylated, esterified, acylated, acetylated, cyclized, or converted into an acid addition salt and/or optionally dimerized or polymerized, or conjugated, as further described herein.

Pharmaceutically Acceptable Salts

In exemplary aspects, the IL-21 mutein is in the form of a salt, e.g., a pharmaceutically acceptable salt. Such salts can be prepared in situ during the final isolation and purification of the IL-21 mutein or separately prepared by reacting a free base function with a suitable acid. Examples of acids which can be employed to form pharmaceutically acceptable acid addition salts include, for example, an inorganic acid, e.g., hydrochloric acid, hydrobromic acid, sulphuric acid, and phosphoric acid, and an organic acid, e.g., oxalic acid, maleic acid, succinic acid, and citric acid.

Representative acid addition salts include, but are not limited to acetate, adipate, alginate, citrate, aspartate, benzoate, benzenesulfonate, bisulfate, butyrate, camphorate, camphor sulfonate, digluconate, glycerophosphate, hemisulfate, heptanoate, hexanoate, fumarate, hydrochloride, hydrobromide, hydroiodide, 2-hydroxyethansulfonate (isothionate), lactate, maleate, methane sulfonate, nicotinate, 2-naphthalene sulfonate, oxalate, palmitoate, pectinate, persulfate, 3-phenylpropionate, picrate, pivalate, propionate, succinate, tartrate, thiocyanate, phosphate, glutamate, bicarbonate, p-toluenesulfonate, and undecanoate.

Basic addition salts also can be prepared in situ during the final isolation and purification of the IL-21 mutein, or by reacting a carboxylic acid-containing moiety with a suitable base such as the hydroxide, carbonate, or bicarbonate of a pharmaceutically acceptable metal cation or with ammonia or an organic primary, secondary, or tertiary amine. Pharmaceutically acceptable salts include, but are not limited to, cations based on alkali metals or alkaline earth metals such as lithium, sodium, potassium, calcium, magnesium, and aluminum salts, and the like, and nontoxic quaternary ammonia and amine cations including ammonium, tetramethylammonium, tetraethylammonium, methylammonium, dimethylammonium, trimethylammonium, triethylammonium, diethylammonium, and ethylammonium, amongst others. Other representative organic amines useful for the formation of base addition salts include, for example, ethylenediamine, ethanolamine, diethanolamine, piperidine, piperazine, and the like.

Further, basic nitrogen-containing groups can be quaternized with such active agents as lower alkyl halides such as methyl, ethyl, propyl, and butyl chlorides, bromides, and iodides; long chain halides such as decyl, lauryl, myristyl, and stearyl chlorides, bromides, and iodides; arylalkyl halides like benzyl and phenethyl bromides and others. Water or oil-soluble or dispersible products are thereby obtained.

Purification

The IL-21 muteins of the present disclosure can be purified. The term "purified" as used herein means having been increased in purity, wherein "purity" is a relative term, and not to be necessarily construed as absolute purity. In exemplary aspects, the purity of the compound (e.g., in the composition) is at least or about 50%, at least or about 60%, at least or about 70%, at least or about 80%, at least or about 90%, at least or about 95%, or at least or about 98% or is about 100%.

Peptidomimetics

In some aspects, the IL-21 mutein is a peptidomimetic, or at least a portion of the mutein is peptidomimetic. Peptidomimetics as well as methods of making the same are known in the art. See, for example, *Advances in Amino Acid Mimetics and Peptidomimetics*, Volumes 1 and 2, ed., Abell, A., JAI Press Inc., Greenwich, C T, 2006. In some aspects, the peptidomimetic is a D-peptide peptidomimetic comprising D-isomer amino acids. In some aspects, the peptidomimetic is a peptoid in which the side chain of an amino acid is connected to the alpha nitrogen atom of the peptide backbone. Methods of making peptoids are known in the art. See, e.g., Zuckermann et al., *JACS* 114(26): 10646-10647 (1992) and *Design, Synthesis, and Evaluation of Novel Peptoids*, Fowler, Sarah, University of Wisconsin-Madison, 2008. In some aspects, the peptidomimetic is a β-peptide comprising βamino acids which have their amino group bonded to the β-cargon rather than the alpha carbon. Methods of making β-peptides are known in the art. See, for example, Seebach et al., *Helvetica Chimica Acta* 79(4): 913-941 (1996).

Binding Characteristics

In exemplary embodiments, the IL-21 muteins bind to the IL-21 receptor (IL-21R) with a reduced affinity, relative to the affinity of wild-type IL-21 for the IL-21R. In exemplary embodiments, the IL-21 muteins bind to the human IL-21R with a reduced affinity, relative to the affinity of wild-type human IL-21 for the human IL-21R. In exemplary embodiments, the IL-21 muteins bind to the alpha chain of the human IL-21R with a reduced affinity, relative to the affinity of wild-type human IL-21 for the alpha chain of the human IL-21R. In specific embodiments, IL-21 muteins which bind to the alpha chain of the human IL-21R with a reduced affinity, relative to the affinity of wild-type human IL-21 for the alpha chain of the human IL-21R contain one, two, or more substitutions located at an amino acid position selected from the group consisting of: 5, 8, 9, 12, 13, 16, 19, 23, 65, 66, 69, 70, 72, 73, 75, 76, 77, 78, 79, and 80, according to the amino acid position numbering of SEQ ID NO: 1. Specific amino acid substitutions that can be made at such positions are discussed herein (see, e.g., Tables A, B, and C).

In exemplary embodiments, the IL-21 muteins bind to the gamma chain of human IL-21R with a reduced affinity, relative to the affinity of wild-type human IL-21 for the gamma chain of the human IL-21R. In specific embodiments, IL-21 muteins which bind to the gamma chain of human IL-21R with a reduced affinity, relative to the affinity of wild-type human IL-21 for the gamma chain of the human IL-21R contain one, two, or more substitutions located at an amino acid position selected from the group consisting of: 11, 14, 15, 109, 110, 112, 113, 116, 117, 119, 120 and 123, according to the amino acid position numbering of SEQ ID NO: 1. Specific amino acid substitutions that can be made at such positions are discussed herein (see, e.g., Tables A, B, and C).

In exemplary embodiments, the IL-21 muteins bind to the gamma chain of human IL-21R with a reduced affinity, relative to the affinity of wild-type human IL-21 for the alpha chain of the human IL-21R. In exemplary embodiments, the IL-21 muteins bind to the cynomolgus monkey IL-21R with a reduced affinity, relative to the affinity of wild-type cynomolgus IL-21 for the cynomolgus IL-21R. In exemplary embodiments, the IL-21 muteins bind to the alpha chain of the cynomolgus monkey IL-21R with a reduced affinity, relative to the affinity of wild-type cynomolgus IL-21 for the alpha chain of the cynomolgus IL-21R. In exemplary embodiments, the IL-21 muteins bind to the gamma chain of cynomolgus monkey IL-21R with a reduced affinity, relative to the affinity of wild-type cynomolgus IL-21 for the gamma chain of the cynomolgus IL-21R. In exemplary embodiments, the IL-21 muteins bind to the gamma chain of cynomolgus monkey IL-21R with a reduced affinity, relative to the affinity of wild-type cynomolgus IL-21 for the alpha chain of the cynomolgus IL-21R.

The IL-21 muteins provided herein bind to IL-21R in a non-covalent and reversible manner. In exemplary embodiments, the binding strength of the muteins to IL-21R may be described in terms of its affinity, a measure of the strength of interaction between the binding site of the mutein and the IL-21R. In exemplary aspects, the IL-21 muteins provided herein have high-affinity for IL-21R and thus will bind a greater amount of IL-21R in a shorter period of time than low-affinity IL-21 muteins. In exemplary aspects, the IL-21 muteins provided herein have low-affinity for IL-21R and thus will bind a lesser amount of IL-21R in a longer period of time than high-affinity IL-21 muteins. In exemplary aspects, the IL-21 mutein has an equilibrium association constant, KA, which is at least $10^5$ $M^{-1}$, at least $10^6$ $M^{-1}$, at least $10^7$ $M^{-1}$, at least $10^8$ $M^{-1}$, at least $10^9$ $M^{-1}$, or at least $10^{10}$ $M^{-1}$. As understood by the artisan of ordinary skill, KA can be influenced by factors including pH, temperature and buffer composition.

In exemplary embodiments, the binding strength of the IL-21 mutein to IL-21R may be described in terms of its sensitivity. $K_D$ is the equilibrium dissociation constant, a ratio of $k_{off}/k_{on}$, between the IL-21 mutein and IL-21R. $K_D$ and KA are inversely related. The $K_D$ value relates to the concentration of the mutein (the amount of mutein needed for a particular experiment) and so the lower the $K_D$ value (lower concentration needed) the higher the affinity of the mutein. In exemplary aspects, the binding strength of the IL-21 mutein to IL-21R may be described in terms of $K_D$. In exemplary aspects, the $K_D$ of the IL-21 muteins provided herein is about $10^{-1}$ M, about $10^{-2}$ M, about $10^{-3}$ M, about $10^{-4}$ M, about $10^{-5}$ M, about $10^{-6}$ M, or less. In exemplary aspects, the $K_D$ of the IL-21 muteins provided herein is micromolar, nanomolar, picomolar or femtomolar. In exemplary aspects, the $K_D$ of the IL-21 muteins provided herein is within a range of about $10^{-4}$ to $10^{-6}$ M, or $10^{-7}$ to $10^{-9}$ M, or $10^{-10}$ to $10^{-12}$ M, or $10^{-13}$ to $10^{-15}$ M. In exemplary aspects, the IL-21 mutein binds to the human IL-21R with a $K_D$ that is greater than or is about 0.04 nM. In exemplary aspects, the IL-21 mutein binds to the human IL-21R with a $K_D$ of about 0.01 nM to about 20 nM, 0.02 nM to 20 nM, 0.05 nM to 20 nM, 0.05 nM to 15 nM, 0.1 nM to 15 nM, 0.1 nM to 10 nM, 1 nM to 10 nM, or 5 nM to 10 nM. In exemplary aspects, the IL-21 mutein binds to the cynomolgus monkey IL-21R with a $K_D$ that is greater than or is about 0.055 nM. In exemplary aspects, the IL-21 mutein binds to the cynomolgus monkey IL-21R with a $K_D$ of about 0.01 nM to about 20 nM, 0.02 nM to 20 nM, 0.05 nM to 20 nM, 0.05 nM to 15 nM, 0.1 nM to 15 nM, 0.1 nM to 10 nM, 1 nM to 10 nM, or 5 nM to 10 nM.

In exemplary embodiments, the IL-21 mutein exhibits a reduction in binding affinity for IL-21R α-chain. In exemplary aspects, the IL-21 mutein is a mutein (e.g., single or double) that exhibits about a 2-, 5-, 10-, 15-, 20-, 25-, 30-, 35-, 40-, 45-, 50-, 55-, 60-, 65-, 70-, 75-, 80-, 85-, 90-, 95-, 100-, 105-, 110-, 115-, 120-, 125-, 130-, 135-, 140-, 145-, 150-, 175-, 200-, 225-, 250-, 275-, 300-, 325-, 350-, 375-, 400-, 425-, 450-, 475-, 500-, 525-, 550-, 575-, 600-, 625-, 650-, 675-, 700-, 725-, 750-, 775-, 800-, 825-, 850-, 875-, 900-, 925-, 950-, 975-fold, 1000-fold, or more reduction in binding affinity for IL-21R α-chain. In exemplary aspects, the IL-21 mutein is a double mutein exhibiting the reduction in binding affinity for IL-21R α-chain.

In exemplary aspects, the above reduction in binding affinity of the IL-21 mutein (e.g., single or double mutein) results in a reduced affinity for IL-21R α-chain compared to the affinity of about 0.025 nM of wild-type human IL-21 for IL-21R α-chain. Accordingly, a 2-fold reduction in affinity as discussed above would result in an IL-21 mutein with an affinity of about 0.05 nM for IL-21R α-chain. Thus, in exemplary embodiments, the IL-21 mutein (e.g., single or double) has an affinity of about 0.05, 0.125, 0.25, 0.375, 0.5, 0.625, 0.75, 0.875, 1.0, 1.125, 1.25, 1.375, 1.5, 1.625, 1.75, 1.875, 2.0, 2.125, 2.25, 2.375, 2.5, 2.625, 2.75, 2.875, 3.0, 3.125, 3.25, 3.375, 3.5, 3.625, 3.75, 4.375, 5, 5.625, 6.25, 6.875, 7.5, 8.125, 8.75, 9.375, 10.0, 10.625, 11.25, 11.875, 12.5, 13.125, 13.75, 14.375, 15.0, 15.625, 16.25, 16.875, 17.5, 18.125, 18.75, 19.375, 20.0, 20.625, 21.25, 21.875, 22.5, 23.125, 23.75, 24.375, 25 nM, or more for IL-21R α-chain. In exemplary aspects, the IL-21 mutein is a double mutein exhibiting a reduced binding affinity for IL-21R α-chain.

In exemplary embodiments, the IL-21 mutein exhibits a reduction in activity as measured by an in vitro STAT3 phosphorylation assay. In exemplary aspects, the IL-21 mutein is a mutein (e.g., single or double) that exhibits about a 2-, 5-, 10-, 15-, 20-, 25-, 30-, 35-, 40-, 45-, 50-, 55-, 60-, 65-, 70-, 75-, 80-, 85-, 90-, 95-, 100-, 105-, 110-, 115-, 120-, 125-, 130-, 135-, 140-, 145-, 150-, 175-, 200-, 225-, 250-, 275-, 300-, 325-, 350-, 375-, 400-, 425-, 450-, 475-, 500-, 525-, 550-, 575-, 600-, 625-, 650-, 675-, 700-, 725-, 750-, 775-, 800-, 825-, 850-, 875-, 900-, 925-, 950-, 975-fold, 1000-fold, or more reduction in activity as measured by a STAT3 phosphorylation assay. In exemplary aspects, the IL-21 mutein is a double mutein exhibiting the reduction in in activity as measured by a STAT3 phosphorylation assay.

IL-21 Mutein Conjugates

The present disclosure also provides conjugates comprising one or more of the IL-21 muteins of the present disclosure linked to a heterologous moiety. As used herein, the term "heterologous moiety" is synonymous with the term "conjugate moiety" and refers to any molecule (chemical or biochemical, naturally-occurring or non-coded) which is different from the IL-21 muteins described herein. Exemplary conjugate moieties that can be linked to any of the IL-21 muteins described herein include but are not limited to a heterologous peptide or polypeptide (including for example, an immunoglobulin or portion thereof (e.g., variable region, CDR, or Fc region)), a targeting agent, a diagnostic label such as a radioisotope, fluorophore or enzymatic label, a polymer including water soluble polymers, or other therapeutic or diagnostic agents. In some embodiments, a conjugate is provided comprising an IL-21 mutein of the present disclosure and an immunoglobulin. The conjugate in some embodiments comprises one or more of the IL-21 muteins described herein and one or more of: a peptide (which is distinct from the IL-21 muteins described herein), a polypeptide, a nucleic acid molecule, an antibody or fragment thereof, a polymer, a quantum dot, a small molecule, a toxin, a diagnostic agent, a carbohydrate, an amino acid.

In exemplary embodiments, the conjugate of the present disclosure comprises an IL-21 mutein as described herein and a heterologous moiety which is a polypeptide (e.g., a polypeptide distinct from any of the IL-21 muteins described herein), and the conjugate is a fusion polypeptide or fusion protein or a chimeric protein or chimeric polypeptide. Additional descriptions of such conjugates are provided herein under "Fusion proteins".

In some embodiments, the heterologous moiety is attached via non-covalent or covalent bonding to the IL-21 mutein of the present disclosure. In exemplary aspects, the linkage between the IL-21 mutein and the heterologous moiety is achieved via covalent chemical bonds, e.g., peptide bonds, disulfide bonds, and the like, or via physical forces, such as electrostatic, hydrogen, ionic, van der Waals, or hydrophobic or hydrophilic interactions. A variety of non-covalent coupling systems may be used, including, e.g., biotin-avidin, ligand/receptor, enzyme/substrate, nucleic acid/nucleic acid binding protein, lipid/lipid binding protein, cellular adhesion molecule partners; or any binding partners or fragments thereof which have affinity for each other.

The IL-21 mutein in exemplary embodiments is linked to a conjugate moiety via direct covalent linkage by reacting targeted amino acid residues of the IL-21 mutein with an organic derivatizing agent that is capable of reacting with selected side chains or the N- or C-terminal residues of these targeted amino acids. Reactive groups on the IL-21 mutein or conjugate moiety include, e.g., an aldehyde, amino, ester, thiol, α-haloacetyl, maleimido or hydrazino group. Derivatizing agents include, for example, maleimidobenzoyl sulfosuccinimide ester (conjugation through cysteine residues), N-hydroxysuccinimide (through lysine residues), glutaraldehyde, succinic anhydride or other agents known in the art. Alternatively, the conjugate moieties can be linked to the IL-21 mutein indirectly through intermediate carriers, such as polysaccharide or polypeptide carriers. Examples of polysaccharide carriers include aminodextran. Examples of suitable polypeptide carriers include polylysine, polyglutamic acid, polyaspartic acid, co-polymers thereof, and mixed polymers of these amino acids and others, e.g., serines, to confer desirable solubility properties on the resultant loaded carrier.

Cysteinyl residues are most commonly reacted with α-haloacetates (and corresponding amines), such as chloroacetic acid, chloroacetamide to give carboxymethyl or carboxyamidomethyl derivatives. Cysteinyl residues also are derivatized by reaction with bromotrifluoroacetone, alpha-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0.

Lysinyl and amino-terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate, pyridoxal phosphate, pyridoxal, chloroborohydride, trinitrobenzenesulfonic acid, O-methylisourea, 2,4-pentanedione, and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl side groups (aspartyl or glutamyl) are selectively modified by reaction with carbodiimides (R—N═C═N—R'), where R and R' are different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Other modifications include hydroxylation of proline and lysine, phosphorylation of hydroxyl groups of seryl or threonyl residues, methylation of the alpha-amino groups of lysine, arginine, and histidine side chains (T. E. Creighton, Proteins: Structure and Molecular Properties, W.H. Freeman & Co., San Francisco, pp. 79-86 (1983)), deamidation of asparagine or glutamine, acetylation of the N-terminal amine, and/or amidation or esterification of the C-terminal carboxylic acid group.

Another type of covalent modification involves chemically or enzymatically coupling glycosides to the IL-21 mutein. Sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of tyrosine, or tryptophan, or (f) the amide group of glutamine. These methods are described in WO87/05330 published 11 Sep. 1987, and in Aplin and Wriston, CRC Crit. Rev. Biochem., pp. 259-306 (1981).

In exemplary aspects, the heterologous moiety is attached to the IL-21 mutein of the present disclosure via a linker. In some aspects, the linker comprises a chain of atoms from 1 to about 60, or 1 to 30 atoms or longer, 2 to 5 atoms, 2 to 10 atoms, 5 to 10 atoms, or 10 to 20 atoms long. In some embodiments, the chain atoms are all carbon atoms. In some embodiments, the chain atoms in the backbone of the linker are selected from the group consisting of C, O, N, and S. Chain atoms and linkers may be selected according to their expected solubility (hydrophilicity) so as to provide a more soluble conjugate. In some embodiments, the linker provides a functional group that is subject to cleavage by an enzyme or other catalyst or hydrolytic conditions found in the target tissue or organ or cell. In some embodiments, the length of the linker is long enough to reduce the potential for steric hindrance. If the linker is a covalent bond or a peptidyl bond and the conjugate is a polypeptide, the entire conjugate can be a fusion protein. Such peptidyl linkers may be any length. Exemplary peptidyl linkers are from about 1 to 50 amino acids in length, 5 to 50, 3 to 5, 5 to 10, 5 to 15, or 10 to 30 amino acids in length, and are flexible or rigid. In exemplary aspects, the linker is a peptide comprising about 2 to about 20 amino acids. In exemplary aspects, the linker is a peptide comprising about 2 to about 15 amino acid, about 2 to about 10 amino acids, or about 2 to about 5 amino acids. Suitable peptide linkers are known in the art. See, e.g., Chen et al., Adv Drug Delivery Reviews 65(10): 1357-1369 (2013); Arai et al., Protein Eng Des Sel 14(8): 529-532 (2001); and Wriggers et al., Curr Trends in Peptide Science 80(6): 736-746 (2005). In exemplary aspects, the linker is a peptide comprising the amino acid sequence GGGGS (SEQ ID NO: 262).

Fusion Proteins

In exemplary embodiments, the IL-21 mutein is linked to a polypeptide which is distinct from any of the IL-21 muteins described herein, and the conjugate is a fusion polypeptide or fusion protein or a chimeric protein or chimeric polypeptide. Accordingly, the present disclosure provides fusion polypeptides or fusion proteins comprising an IL-21 mutein of the present disclosure and a heterologous polypeptide or peptide. In exemplary aspects, the fusion protein of the present disclosure comprises an IL-21 mutein of the present disclosure linked to an antigen-binding protein. In exemplary aspects, the antigen-binding protein is an antibody or immunoglobulin, or an antigen binding antibody fragment thereof, or an antibody protein product.

Collectively, antibodies form a family of plasma proteins known as immunoglobulins and comprise of immunoglobulin domains. (Janeway et al., Immunobiology: The Immune System in Health and Disease, $4^{th}$ ed., Elsevier Science Ltd./Garland Publishing, 1999. As used herein, the term "antibody" refers to a protein having a conventional immunoglobulin format, comprising heavy and light chains, and comprising variable and constant regions. For example, an antibody may be an IgG which is a "Y-shaped" structure of two identical pairs of polypeptide chains, each pair having one "light" (typically having a molecular weight of about 25 kDa) and one "heavy" chain (typically having a molecular weight of about 50-70 kDa). An antibody has a variable region and a constant region. In IgG formats, the variable region is generally about 100-110 or more amino acids, comprises three complementarity determining regions (CDRs), is primarily responsible for antigen recognition, and substantially varies among other antibodies that bind to different antigens. The constant region allows the antibody to recruit cells and molecules of the immune system. The variable region is made of the N-terminal regions of each light chain and heavy chain, while the constant region is made of the C-terminal portions of each of the heavy and light chains. (Janeway et al., "Structure of the Antibody Molecule and the Immunoglobulin Genes", Immunobiology: The Immune System in Health and Disease, $4^{th}$ ed. Elsevier Science Ltd./Garland Publishing, (1999)).

The general structure and properties of CDRs of antibodies have been described in the art. Briefly, in an antibody scaffold, the CDRs are embedded within a framework in the heavy and light chain variable region where they constitute the regions largely responsible for antigen binding and recognition. A variable region typically comprises at least three heavy or light chain CDRs (Kabat et al., 1991, Sequences of Proteins of Immunological Interest, Public Health Service N.I.H., Bethesda, Md.; see also Chothia and Lesk, 1987, J. Mol. Biol. 196:901-917; Chothia et al., 1989, Nature 342: 877-883), within a framework region (designated framework regions 1-4, FR1, FR2, FR3, and FR4, by Kabat et al., 1991; see also Chothia and Lesk, 1987, supra).

Antibodies can comprise any constant region known in the art. Human light chains are classified as kappa and lambda light chains. Heavy chains are classified as mu, delta, gamma, alpha, or epsilon, and define the antibody's isotype as IgM, IgD, IgG, IgA, and IgE, respectively. IgG has several subclasses, including, but not limited to IgG1, IgG2, IgG3, and IgG4. IgM has subclasses, including, but not limited to, IgM1 and IgM2. Embodiments of the present disclosure include all such classes or isotypes of antibodies. The light chain constant region can be, for example, a kappa- or lambda-type light chain constant region, e.g., a human kappa- or lambda-type light chain constant region. The heavy chain constant region can be, for example, an alpha-, delta-, epsilon-, gamma-, or mu-type heavy chain constant regions, e.g., a human alpha-, delta-, epsilon-, gamma-, or mu-type heavy chain constant region. Accordingly, in exemplary embodiments, the antibody is an antibody of isotype IgA, IgD, IgE, IgG, or IgM, including any one of IgG1, IgG2, IgG3 or IgG4.

The antibody can be a monoclonal antibody or a polyclonal antibody. In some embodiments, the antibody comprises a sequence that is substantially similar to a naturally-occurring antibody produced by a mammal, e.g., mouse, rabbit, goat, horse, chicken, hamster, human, and the like. In this regard, the antibody can be considered as a mammalian antibody, e.g., a mouse antibody, rabbit antibody, goat antibody, horse antibody, chicken antibody, hamster antibody, human antibody, and the like. In certain aspects, the antibody is a human antibody. In certain aspects, the antibody is a chimeric antibody or a humanized antibody. The term "chimeric antibody" refers to an antibody containing domains from two or more different antibodies. A chimeric antibody can, for example, contain the constant domains from one species and the variable domains from a second, or more generally, can contain stretches of amino acid sequence from at least two species. A chimeric antibody also can contain domains of two or more different antibodies within the same species. The term "humanized" when used in relation to antibodies refers to antibodies having at least CDR regions from a non-human source which are engineered to have a structure and immunological function more similar to true human antibodies than the original source antibodies. For example, humanizing can involve grafting a CDR from a non-human antibody, such as a mouse antibody, into a human antibody. Humanizing also can involve select amino acid substitutions to make a non-human sequence more similar to a human sequence.

An antibody can be cleaved into fragments by enzymes, such as, e.g., papain and pepsin. Papain cleaves an antibody to produce two Fab fragments and a single Fc fragment. Pepsin cleaves an antibody to produce a $F(ab')_2$ fragment and a pFc' fragment. In exemplary aspects of the present disclosure, the fusion protein of the present disclosure comprises an antigen binding antibody fragment. As used herein, the term "antigen binding antibody fragment refers to a portion of an antibody molecule that is capable of binding to the antigen of the antibody and is also known as "antigen-binding fragment" or "antigen-binding portion". In exemplary instances, the antigen binding antibody fragment is a Fab fragment or a $F(ab')_2$ fragment.

The architecture of antibodies has been exploited to create a growing range of alternative formats that span a molecular-weight range of at least about 12-150 kDa and has a valency (n) range from monomeric (n=1), to dimeric (n=2), to trimeric (n=3), to tetrameric (n=4), and potentially higher; such alternative formats are referred to herein as "antibody protein products". Antibody protein products include those based on the full antibody structure and those that mimic antibody fragments which retain full antigen-binding capacity, e.g., scFvs, Fabs and VHH/VH (discussed below). The smallest antigen binding antibody fragment that retains its complete antigen binding site is the Fv fragment, which consists entirely of variable (V) regions. A soluble, flexible amino acid peptide linker is used to connect the V regions to a scFv (single chain fragment variable) fragment for stabilization of the molecule, or the constant (C) domains are added to the V regions to generate a Fab fragment [fragment, antigen-binding]. Both scFv and Fab fragments can be easily produced in host cells, e.g., prokaryotic host cells. Other antibody protein products include disulfide-bond stabilized scFv (ds-scFv), single chain Fab (scFab), as well as di- and multimeric antibody formats like dia-, tria- and tetra-bodies, or minibodies (miniAbs) that comprise different formats consisting of scFvs linked to oligomerization domains. The smallest fragments are VHH/VH of camelid heavy chain Abs as well as single domain Abs (sdAb). The building block that is most frequently used to create novel antibody formats is the single-chain variable (V)-domain antibody fragment (scFv), which comprises V domains from the heavy and light chain (VH and VL domain) linked by a peptide linker of ~15 amino acid residues. A peptibody or peptide-Fc fusion is yet another antibody protein product. The structure of a peptibody consists of a biologically active peptide grafted onto an Fc domain. Peptibodies are well-described in the art. See, e.g., Shimamoto et al., mAbs 4(5): 586-591 (2012).

Other antibody protein products include a single chain antibody (SCA); a diabody; a triabody; a tetrabody; bispecific or trispecific antibodies, and the like. Bispecific antibodies can be divided into five major classes: BsIgG, appended IgG, BsAb fragments, bispecific fusion proteins and BsAb conjugates. See, e.g., Spiess et al., Molecular Immunology 67(2) Part A: 97-106 (2015).

In exemplary aspects, the fusion protein of the present disclosure comprises any one of these antibody protein products. In exemplary aspects, the fusion protein of the present disclosure comprises any one of an scFv, Fab VHH/VH, Fv fragment, ds-scFv, scFab, dimeric antibody, multimeric antibody (e.g., a diabody, triabody, tetrabody), miniAb, peptibody VHH/VH of camelid heavy chain antibody, sdAb, diabody; a triabody; a tetrabody; a bispecific or trispecific antibody, BsIgG, appended IgG, BsAb fragment, bispecific fusion protein, and BsAb conjugate.

In exemplary instances, the fusion protein of the present disclosure comprises an antibody protein product in monomeric form, or polymeric, oligomeric, or multimeric form. In certain embodiments in which the antibody comprises two or more distinct antigen binding regions fragments, the antibody is considered bispecific, trispecific, or multi-specific, or bivalent, trivalent, or multivalent, depending on the number of distinct epitopes that are recognized and bound by the antibody.

In exemplary embodiments, the antibody, antigen binding antibody fragment or antibody protein product binds to a tumor antigen. In exemplary aspects, the tumor antigen is an antigen derived from a viral protein, an antigen derived from point mutations, or an antigen encoded by a cancer-germline gene. In exemplary aspects, the tumor antigen is p53, KRAS, NRAS, MAGEA, MAGEB, MAGEC, BAGE, GAGE, LAGE/NY-ESO1, SSX, tyrosinase, gp100/pmel 17, Melan-A/MART-1, gp75/TRP1, TRP2, CEA, RAGE-1, HER2/NEU, WT1. In exemplary aspects, the antibody, antigen binding antibody fragment or antibody protein product of the fusion protein of the present disclosure binds to an immunotherapy agent or is an immunotherapy agent, as described herein. In exemplary aspects, the antibody, antigen binding antibody fragment or antibody protein product of the fusion protein of the present disclosure binds to a cytokine, lymphokine, growth factor, or hematopoietic factor, as described herein.

In exemplary embodiments, the fusion protein of the present disclosure comprises a cytokine (e.g., an IL-21 mutein described herein) and an antibody, antigen binding antibody fragment thereof or antibody protein product, which binds to a protein of the immune checkpoint pathway, a tumor antigen, a cytokine, lymphokine, growth factor, or other hematopoietic factor, including but not limited to any of those described herein. In exemplary embodiments, the fusion protein of the present disclosure comprises a cytokine (e.g., an IL-21 mutein described herein) and an antibody, antigen binding antibody fragment thereof or antibody protein product, which binds to a protein of the immune checkpoint pathway selected from the group consisting of: CTLA-4, PD-1, PD-L1, PD-L2, B7-H3, B7-H4, CEACAM-1, TIGIT, LAG3, CD112, CD112R, CD96, TIM3, BTLA, or co-stimulatory receptor: ICOS, OX40, 41BB, CD27, GITR.

In other embodiments, the fusion protein of the present disclosure comprises a cytokine and an antibody (or antigen binding antibody fragment thereof) which binds to a protein of the immune checkpoint pathway. Suitable cytokines include, for example, cytokines that enhance TH-1-type responses; and cytokines that activate STAT 1, 3, 4, or 5. In some embodiments, the cytokine is an interleukin. In other embodiments, the cytokine is an interleukin that enhances T cell activity such as, for example, IL-2, IL-7, IL-10, IL-12, IL-15, or IL-21. Such cytokines can be modified (e.g., via mutations) to attenuate their affinity for their respective receptor. Such muteins can exhibit improved safety profiles by reducing off-target and unwanted interactions. Thus, the cytokines can be modified to generate IL-2, IL-7, IL-10, IL-12, IL-15, or IL-21 muteins. In a particular embodiment, the cytokine is an IL-21 mutein described herein. Suitable antibodies (or antigen binding antibody fragments thereof) which binds to a protein of the immune checkpoint pathway include, for example, those which bind CTLA-4, PD-1, PD-L1, PD-L2, B7-H3, B7-H4, TIGIT, LAG3, CD112 TIM3, BTLA, or co-stimulatory receptor: ICOS, OX40, 41BB, or GITR. In a particular embodiment, the antibody (or antigen binding antibody fragment thereof) binds to PD-1 (e.g., human PD-1).

In other embodiments, the fusion protein of the present disclosure is a multispecific fusion protein which comprises a cytokine, an antibody (or antigen binding antibody fragment thereof), and at least one additional targeting moiety. For example, the fusion protein of the present disclosure may be a trispecific fusion protein which comprises a cytokine, an antibody (or antigen binding antibody fragment thereof), and one additional targeting moiety.

In exemplary embodiments, the fusion protein of the present disclosure comprises an IL-21 mutein described herein and a PD-1 binding antagonist. The term "PD-1 binding antagonist" refers to a molecule that decreases, blocks, inhibits, abrogates or interferes with signal transduction resulting from the interaction of PD-1 with one or more of its binding partners, such as PD-L1, PD-L2. In some embodiments, the PD-1 binding antagonist is a molecule that inhibits the binding of PD-1 to one or more of its binding partners. In a specific aspect, the PD-1 binding antagonist inhibits the binding of PD-1 to PD-L1 and/or PD-L2. For example, PD-1 binding antagonists include anti-PD-1 antibodies, antigen binding antibody fragments thereof, immunoadhesins, fusion proteins, oligopeptides and other molecules that decrease, block, inhibit, abrogate or interfere with signal transduction resulting from the interaction of PD-1 with PD-L1 and/or PD-L2. In one embodiment, a PD-1 binding antagonist reduces the negative co-stimulatory signal mediated by or through cell surface proteins expressed on T lymphocytes mediated signaling through PD-1 so as render a dysfunctional T-cell less dysfunctional (e.g., enhancing effector responses to antigen recognition). In some embodiments, the PD-1 binding antagonist is an anti-PD-1 antibody. Examples of anti-PD-1 antibodies include nivolumab (BMS-936558), pembrolizumab (MK-3475), BMS 936558, BMS-936559, TSR-042 (Tesaro), ePDR001 (Novartis), and pidilizumab (CT-011). Additional specific examples of PD-1 binding antagonists are provided infra.

In exemplary embodiments, the PD-1 binding antagonist comprises, consists essentially of, or consists of an antigen-binding protein which binds to PD-1. In exemplary aspects, the antigen-binding protein is an antibody, antigen binding antibody fragment thereof, or an antibody protein product, which binds to PD-1.

In exemplary aspects, the fusion protein of the present disclosure comprises an IL-21 mutein, as described herein, and an anti-PD-1 antibody (as described herein), an antigen binding antibody fragment thereof, or an anti-PD-1 antibody protein product. In exemplary instances, the anti-PD-1 antibody is a monoclonal IgG. In exemplary instances, the anti-PD-1 antibody, antigen binding antibody fragment thereof, or anti-PD-1 antibody protein product is a monovalent or bivalent. In exemplary aspects, the anti-PD-1 antibody, antigen binding antibody fragment thereof, or anti-PD-1 antibody protein product binds to human PD-1, which has the amino acid sequence of SEQ ID NO: 263. In exemplary aspects, the anti-PD-1 antibody, antigen binding antibody fragment thereof, or anti-PD-1 antibody protein product binds to cynomolgus PD-1, which has the amino acid sequence of SEQ ID NO: 264. In exemplary instances, the anti-PD-1 antibody, antigen binding antibody fragment thereof, or anti-PD-1 antibody protein product binds to both human PD-1 and cynomolgus PD-1. In exemplary instances, the fusion protein of the present disclosure comprises an IL-21 mutein (as described herein) and an anti-PD-1 antibody (as described herein).

In exemplary embodiments, the binding strength of the anti-PD-1 antibody, antigen binding antibody fragment thereof, or anti-PD-1 antibody protein product to PD-1 may be described in terms of $K_D$. In exemplary aspects, the $K_D$ of the anti-PD-1 antibody, antigen binding antibody fragment thereof, or anti-PD-1 antibody protein product provided herein is about $10^{-1}$ M, about $10^{-2}$ M, about $10^{-3}$ M, about $10^{-4}$ M, about $10^{-5}$ M, about $10^{-6}$ M, about $10^{-7}$ M, about $10^{-8}$ M, about $10^{-9}$ M, or less. In exemplary aspects, the $K_D$ of the anti-PD-1 antibody, antigen binding antibody fragment thereof, or anti-PD-1 antibody protein product provided herein is micromolar, nanomolar, picomolar or femtomolar. In exemplary aspects, the $K_D$ of the anti-PD-1 antibody, antigen binding antibody fragment thereof, or anti-PD-1 antibody protein product provided herein is within a range of about $10^{-4}$ to $10^{-6}$ M, or $10^{-7}$ to $10^{-9}$ M, or $10^{-10}$ to $10^{-12}$ M, or $10^{-13}$ to $10^{-15}$ M. In exemplary aspects, the anti-PD-1 antibody, antigen binding antibody fragment thereof, or anti-PD-1 antibody protein product has high affinity for human PD-1, cynomolgus PD-1, or both. In exemplary aspects, the anti-PD-1 antibody, antigen binding antibody fragment thereof, or anti-PD-1 antibody protein product has a $K_D$ for human PD-1 of less than 100 pM, optionally, about 1 pM to about 50 pM. In exemplary aspects, the anti-PD-1 antibody, antigen binding antibody fragment thereof, or anti-PD-1 antibody protein product has a $K_D$ for human PD-1 within about 1 pM to about 20 pM or less than about 10 pM. In exemplary aspects, the anti-PD-1 antibody, a antigen binding antibody fragment thereof, or anti-PD-1 antibody protein product has a $K_D$ for cynomolgus PD-1 of less than 100 pM, optionally, about 1 pM to about 75 pM. In exemplary aspects, the anti-PD-1 antibody, antigen binding antibody fragment thereof, or anti-PD-1 antibody protein product has a $K_D$ for cynomolgus PD-1 within about 1 pM to about 20 pM or less than 10 pM.

In exemplary instances, the anti-PD-1 antibody, antigen binding antibody fragment thereof, or anti-PD-1 antibody protein product is a PD-1 binding antagonist that decreases, blocks, inhibits, abrogates or interferes with signal transduction resulting from the interaction of PD-1 with one or more of its binding partners, such as PD-L1, PD-L2. In exemplary aspects, the anti-PD-1 antibody, antigen binding antibody fragment thereof, or anti-PD-1 antibody protein product blocks PD-1 from binding to its ligand PD-L1 or PD-L2. In exemplary aspects, the anti-PD-1 antibody, antigen binding antibody fragment thereof, or anti-PD-1 antibody protein product inhibits at least 50% of the binding interactions between PD-1 and PD-L1 or PD-L2. In exemplary aspects, the anti-PD-1 antibody, antigen binding antibody fragment thereof, or anti-PD-1 antibody protein product exhibits at least about 50%, at least about 60%, or at least about 70% inhibition of the binding interaction between PD-1 and PD-L1 or PD-L2.

In exemplary instances, the anti-PD-1 antibody, antigen binding antibody fragment thereof, or anti-PD-1 antibody protein product inhibits PD-1-mediated production of IL-2 by T cells in a mixed lymphocyte reaction (MLR). In exemplary aspects, the $IC_{50}$ of the anti-PD-1 antibody, antigen binding antibody fragment thereof, or anti-PD-1 antibody protein product in the MLR is within about 0.1 nM to about 5 nM. In exemplary aspects, the $IC_{50}$ of the anti-PD-1 antibody, antigen binding antibody fragment thereof, or anti-PD-1 antibody protein product in the MLR is less than 2 nM or less than 1 nM. In exemplary aspects, the $IC_{50}$ of the anti-PD-1 antibody, antigen binding antibody fragment thereof, or anti-PD-1 antibody protein product in the MLR is about 0.5 nM to about 2 nM.

In exemplary instances, the anti-PD-1 antibody (or antigen binding antibody fragment thereof) comprises (a) a heavy chain (HC) complementarity-determining region (CDR) 1 amino acid sequence selected from the group consisting of: SEQ ID NOs: 312, 322, 332, 342, 352, 362, 372, and 382, (see Table D) or a variant sequence thereof which differs by only one or two amino acids or which has at least or about 70% sequence identity; (b) an HC CDR2 amino acid sequence selected from the group consisting of: SEQ ID NOs: 313, 323, 333, 343, 353, 363, 373, and 383, (see Table D) or a variant sequence thereof which differs by only one or two amino acids or which has at least or about 70% sequence identity; (c) an HC CDR3 amino acid sequence selected from the group consisting of: SEQ ID NOs: 314, 324, 334, 344, 354, 364, 374, and 384, (see Table D) or a variant sequence thereof which differs by only one or two amino acids or which has at least or about 70% sequence identity; (d) a light chain (LC) CDR1 amino acid sequence selected from the group consisting of: 315, 325, 335, 345, 355, 365, 375, and 385, (see Table D) or a variant sequence thereof which differs by only one or two amino acids or which has at least or about 70% sequence identity; (e) an LC CDR2 amino acid sequence selected from the group consisting of: 316, 326, 336, 346, 356, 366, 376, and 386, (see Table D) or a variant sequence thereof which differs by only one or two amino acids or which has at least or about 70% sequence identity; (f) an LC CDR3 amino acid sequence selected from the group consisting of: 317, 327, 337, 347, 357, 367, 377, and 387, (see Table D) or a variant sequence thereof which differs by only one or two amino acids or which has at least or about 70% sequence identity; or (g) a combination of any two, three, four, five, or six of (a)-(f). In some embodiments, the anti-PD-1 antibody protein product comprises such CDRs.

TABLE D

| | 20A2 | 20C1 | 22D4 | 20C1.006 | 20C1.009 | 20A2.003 | 22D4.006 | 22D4.017 |
|---|---|---|---|---|---|---|---|---|
| HC CDR1 | 312 | 322 | 332 | 342 | 352 | 362 | 372 | 382 |
| HC CDR2 | 313 | 323 | 333 | 343 | 353 | 363 | 373 | 383 |
| HC CDR3 | 314 | 324 | 334 | 344 | 354 | 364 | 374 | 384 |
| LC CDR1 | 315 | 325 | 335 | 345 | 355 | 365 | 375 | 385 |
| LC CDR2 | 316 | 326 | 336 | 346 | 356 | 366 | 376 | 386 |
| LC CDR3 | 317 | 327 | 337 | 347 | 357 | 367 | 377 | 387 |

Number represents the relevant SEQ ID NO.

In exemplary aspects, the anti-PD-1 antibody (or antigen binding antibody fragment thereof) comprises a LC CDR1 amino acid sequence, a LC CDR2 amino acid sequence, and a LC CDR3 amino acid sequence set forth in Table D and at least 1 or 2 of the HC CDR amino acid sequences set forth in Table D. In exemplary aspects, the anti-PD-1 antibody (or antigen binding antibody fragment thereof) comprises a HC CDR1 amino acid sequence, a HC CDR2 amino acid sequence, and a HC CDR3 amino acid sequence set forth in Table D and at least 1 or 2 of the LC CDR amino acid sequences set forth in Table D. In some embodiments, the anti-PD-1 antibody protein product comprises such CDRs.

In exemplary embodiments, the anti-PD-1 antibody (or antigen binding antibody fragment thereof) comprises 3, 4, 5, or all 6 of the amino acid sequences designated by the SEQ ID NOs: in a single column of Table D. In exemplary embodiments, the anti-PD-1 antibody (or antigen binding antibody fragment thereof) comprises each of the LC CDR amino acid sequences designated by the SEQ ID NOs: of a single column of Table D and at least 1 or 2 of the HC CDR amino acid sequences designated by the SEQ ID NOs: in the same single column or another single column of Table D. In exemplary embodiments, the anti-PD-1 antibody (or antigen binding antibody fragment thereof) comprises each of the HC CDR amino acid sequences designated by the SEQ ID NOs: of a single column of Table D and at least 1 or 2 of the LC CDR amino acid sequences designated by the SEQ ID NOs: in the same single column or another single column of Table D. In exemplary embodiments, the anti-PD-1 antibody (or antigen binding antibody fragment thereof) comprises six CDR amino acid sequences selected from the group consisting of: (a) SEQ ID NOs: 312-317; (b) SEQ ID NOs: 322-327; (c) SEQ ID NOs: 332-337; (d) SEQ ID NOs: 342-347; (e) SEQ ID NOs: 352-357; (f) SEQ ID NOs: 362-367; (g) SEQ ID NOs: 372-377; and (h) SEQ ID NOs: 382-387. In specific embodiments, the anti-PD-1 antibody (or antigen binding antibody fragment thereof) comprises all 6 of the CDR amino acid sequences in Table D for any one of the 20A2, 20C1, 22D4, 20C1.006, 20C1.009, 20A2.003, 22D4.006, or 22D4.017 antibodies. In some embodiments, the anti-PD-1 antibody protein product comprises such CDRs.

In exemplary instances, the amino acid sequences of Table D are separated by at least one or more (e.g., at least 2, 3, 4, 5, 6, 7, 8, 9, 10, or more) intervening amino acid(s). In exemplary instances, there are about 10 to about 20 amino acids between the sequences of the LC CDR1 and the LC CDR2 and about 25 to about 40 amino acids between the sequences of the LC CDR2 and the LC CDR3. In exemplary instances, there are about 14 to about 16 amino acids between the sequences of the LC CDR1 and the LC CDR2 and about 30 to about 35 amino acids between the sequences of LC CDR2 and the LC CDR3. In exemplary instances, there are about 10 to about 20 amino acids between the sequences of the HC CDR1 and HC CDR2 and about 25 to about 40 amino acids between the sequences of the HC CDR2 and the HC CDR3. In exemplary instances, there are about 14 to about 16 amino acids between the sequences of the HC CDR1 and HC CDR2 and about 30 to about 35 amino acids between the sequences of the HC CDR2 and HC CDR3.

In exemplary embodiments, the anti-PD-1 antibody (or antigen binding antibody fragment thereof) comprises (a) a heavy chain variable region amino acid sequence selected from the group consisting of: 318, 328, 338, 348, 358, 368, 378, and 388, (see Table E) or a variant sequence thereof which differs by only one or two amino acids or which has at least or about 70% sequence identity; or (b) a light chain variable region amino acid sequence selected from the group consisting of: 319, 329, 339, 349, 359, 369, 379, and 389, (see Table E) or a variant sequence thereof which differs by only one or two amino acids or which has at least or about 70% sequence identity; or (c) both (a) and (b). In some embodiments, the anti-PD-1 antibody protein product comprises such variable regions.

TABLE E

| | 20A2 | 20C1 | 22D4 | 20C1.006 | 20C1.009 | 20A2.003 | 22D4.006 | 22D4.017 |
|---|---|---|---|---|---|---|---|---|
| HC VARIABLE | 318 | 328 | 338 | 348 | 358 | 368 | 378 | 388 |
| LC VARIABLE | 319 | 329 | 339 | 349 | 359 | 369 | 379 | 389 |
| HC (full length) | 320 | 330 | 340 | 350 | 360 | 370 | 380 | 390 |
| LC (full length) | 321 | 331 | 341 | 351 | 361 | 371 | 381 | 391 |

Number represents the relevant SEQ ID NO.

In exemplary embodiments, the anti-PD-1 antibody (or antigen binding antibody fragment thereof) comprises a pair of amino acid sequences selected from the group consisting of: (a) SEQ ID NOs: 318 and 319; (b) SEQ ID NOs: 328 and 329; (c) SEQ ID NOs: 338 and 339; (d) SEQ ID NOs: 348 and 349; (e) SEQ ID NOs: 358 and 359; (f) SEQ ID NOs: 368 and 369; (g) SEQ ID NOs: 378 and 379; and (h) SEQ ID NOs: 388 and 389.

In exemplary embodiments, the anti-PD-1 antibody (or antigen binding antibody fragment thereof) comprises (a) a heavy chain amino acid sequence selected from the group consisting of: 320, 330, 340, 350, 360, 370, 380, and 390, (see Table E) or a variant sequence thereof which differs by only one or two amino acids or which has at least or about 70% sequence identity; or (b) a light chain amino acid sequence selected from the group consisting of: 321, 331, 341, 351, 361, 371, 381, and 391, (see Table E) or a variant sequence thereof which differs by only one or two amino acids or which has at least or about 70% sequence identity; or (c) both (a) and (b). In some embodiments, the anti-PD-1 antibody protein product comprises such variable regions.

In exemplary embodiments, the anti-PD-1 antibody (or antigen binding antibody fragment thereof) comprises a pair of amino acid sequences selected from the group consisting of: (a) SEQ ID NOs: 320 and 321; (b) SEQ ID NOs: 330 and 331; (c) SEQ ID NOs: 340 and 341; (d) SEQ ID NOs: 350 and 351; (e) SEQ ID NOs: 360 and 361; (f) SEQ ID NOs: 370 and 371; (g) SEQ ID NOs: 380 and 381; and (h) SEQ ID NOs: 390 and 391. In some embodiments, the anti-PD-1 antibody protein product comprises such regions.

In exemplary aspects, the anti-PD-1 antibody (or antigen binding antibody fragment thereof) heavy chain amino acid sequences comprise a set of charge pair mutations, as described herein. In particular aspects, the anti-PD-1 antibody (or antigen binding antibody fragment thereof) heavy chain amino acid sequences comprise charge pair mutations selected from V1, V103, and V131 charge pair mutations.

In exemplary aspects, the anti-PD-1 antibody, antigen binding antibody fragment thereof, or anti-PD-1 antibody protein product comprises an amino acid sequence which is similar to an above-referenced amino acid sequence, yet the antigen-binding protein substantially retains its biological function, e.g., its ability to bind to PD-1, e.g., human PD-1, cynomolgus PD-1, or to decrease, block, inhibit, abrogate or interfere with signal transduction resulting from the interaction of PD-1 with one or more of its binding partners, such as PD-L1 or PD-L2.

In exemplary aspects, the anti-PD-1 antibody, antigen binding antibody fragment thereof, or anti-PD-1 antibody protein product comprises an amino acid sequence which differs by only 1, 2, 3, 4, 5, 6, or more amino acids, relative to the above-referenced amino acid sequence(s). In exemplary aspects, the anti-PD-1 antibody, antigen binding antibody fragment thereof, or anti-PD-1 antibody protein product comprises a variant sequence of the referenced sequence, which variant sequence differs by only one or two amino acids, relative to the referenced sequence. In exemplary aspects, the antigen-binding protein comprises one or more amino acid substitutions that occur outside of the CDRs, e.g., the one or more amino acid substitutions occur within the framework region(s) of the heavy or light chain. In exemplary aspects, the anti-PD-1 antibody, antigen binding antibody fragment thereof, or anti-PD-1 antibody protein product comprises one or more amino acid substitutions yet the antigen-binding protein retains the amino acid sequences of the six CDRs. In exemplary aspects, the anti-PD-1 antibody, antigen binding antibody fragment thereof, or anti-PD-1 antibody protein product comprises an amino acid sequence having only 1, 2, 3, 4, 5, 6, or more conservative amino acid substitutions, relative to the above-referenced amino acid sequence(s).

In exemplary aspects, the anti-PD-1 antibody, antigen binding antibody fragment thereof, or anti-PD-1 antibody protein product comprises an amino acid sequence which has greater than or about 30%, greater than or about 50%, or greater than or about 70% sequence identity to the above-referenced amino acid sequence(s). In exemplary aspects, the antigen-binding protein comprises an amino acid sequence which has at least 30%, at least 40%, at least 50%, at least 60%, at least 70%, at least 80%, at least 85%, at least 90% or has greater than 90% sequence identity to the above-referenced amino acid sequence. In exemplary aspects, the antigen-binding protein comprises an amino acid sequence that has at least 70%, at least 80%, at least 85%, at least 90% or has greater than 90% sequence identity along the full-length of the above-referenced amino acid sequence. In exemplary aspects, the antigen-binding protein comprises an amino acid sequence having at least 95%, 96%, 97%, 98% or 99% sequence identity along the full-length of the above-referenced amino acid sequence.

In exemplary aspects, the anti-PD-1 antibody, antigen binding antibody fragment thereof, or anti-PD-1 antibody protein product comprises a variant sequence of the referenced sequence, which variant sequence has at least or about 70% sequence identity, relative to the above-referenced sequence. In exemplary aspects, the anti-PD-1 antibody, antigen binding antibody fragment thereof, or anti-PD-1 antibody protein product comprises a variant sequence of the referenced sequence, which variant sequence has at least or about 80% sequence identity, relative to the above-referenced sequence. In exemplary aspects, the anti-PD-1 antibody, antigen binding antibody fragment thereof, or anti-PD-1 antibody protein product comprises a variant sequence of the referenced sequence, which variant sequence has at least or about 90% sequence identity, relative to the above-referenced sequence. In exemplary aspects, the anti-PD-1 antibody, antigen binding antibody fragment thereof, or anti-PD-1 antibody protein product comprises a variant sequence of the referenced sequence, which variant sequence has at least or about 95% sequence identity, relative to the above-referenced sequence.

In exemplary embodiments, the anti-PD-1 antibody (or antigen binding antibody fragment thereof) comprises one, two, three, four, or five sequences of the SEQ ID NOs. in a single column of Table D and at least one variant sequence having at least or about 70% (e.g., at least about 80%, at least about 90%, at least about 95%) sequence identity to any of SEQ ID NOs: 312-387. In exemplary embodiments, the anti-PD-1 antibody (or antigen binding antibody fragment thereof) comprises one, two, three, four, or five sequences of a set of sequences selected from: (a) SEQ ID NOs: 312-317; (b) SEQ ID NOs: 322-327; (c) SEQ ID NOs: 332-337; (d) SEQ ID NOs: 342-347; (e) SEQ ID NOs: 352-357; (f) SEQ ID NOs: 362-367; (g) SEQ ID NOs: 372-377; and (h) SEQ ID NOs: 382-387, wherein the antibody or fragment thereof further comprises at least one variant sequence having at least or about 70% (e.g., at least about 80%, at least about 90%, at least about 95%) sequence identity to at least one of the sequences of the set. For instance, in exemplary aspects, the anti-PD-1 antibody (or antigen binding antibody fragment thereof) comprises four sequences of SEQ ID NOs: 312-317, namely, SEQ ID NOs: 312-315, wherein the antibody or fragment thereof comprises two variant sequences: one variant sequence having at least or about 70% (e.g., at least about 80%, at least about 90%) sequence identity to SEQ ID NO: 316 and another variant sequence having at least or about 70% (e.g., at least about 80%, at least about 90%, at least about 95%) sequence identity to SEQ ID NO: 317. In some embodiments, the anti-PD-1 antibody protein product comprises such regions.

In exemplary embodiments, the anti-PD-1 antibody (or antigen binding antibody fragment thereof) product comprises a pair of variant sequences having at least or about 70% (e.g., at least about 80%, at least about 90%, at least about 95%) sequence identity to any of SEQ ID NOs: 318, 319, 328, 329, 338, 339, 348, 349, 358, 359, 368, 369, 378, 379, 388, and 389. In exemplary instances, the antibody or fragment thereof comprises a pair of variant sequences which have at least or about 70% (e.g., at least about 80%, at least about 90%, at least about 95%) sequence identity to (a) SEQ ID NOs: 318 and 319; (b) SEQ ID NOs: 328 and 329; (c) SEQ ID NOs: 338 and 339; (d) SEQ ID NOs: 348 and 349; (e) SEQ ID NOs: 358 and 359; (f) SEQ ID NOs: 368 and 369; (g) SEQ ID NOs: 378 and 379; and (h) SEQ ID NOs: 388 and 389. In exemplary embodiments, the anti-PD-1 antibody (or antigen binding antibody fragment thereof) comprises a pair of sequences: one sequence of Table E and another sequence which is a variant sequence having at least or about 70% (e.g., at least about 80%, at least about 90%, at least about 95%) sequence identity to any of SEQ ID NOs: 318, 319, 328, 329, 338, 339, 348, 349, 358, 359, 368, 369, 378, 379, 388, and 389. In exemplary embodiments, the anti-PD-1 antibody (or antigen binding antibody fragment thereof) comprises a pair of sequences: one sequence selected from (a) SEQ ID NOs: 318 and 319; (b) SEQ ID NOs: 328 and 329; (c) SEQ ID NOs: 338 and 339; (d) SEQ ID NOs: 348 and 349; (e) SEQ ID NOs: 358 and 359; (f) SEQ ID NOs: 368 and 369; (g) SEQ ID NOs: 378 and 379; and (h) SEQ ID NOs: 388 and 389, and another sequence which is a variant sequence having at least or about 70% (e.g., at least about 80%, at least about 90%, at least about 95%) sequence identity to a sequence of (a)-(u). For instance, in exemplary aspects, the anti-PD-1 antibody (or antigen binding antibody fragment thereof) comprises the sequence of SEQ ID NO: 318 and further comprises a variant sequence having at least or about 70% (e.g., at least about 80%, at least about 90%, at least about 95%) sequence identity to SEQ ID NO 319. In some embodiments, the anti-PD-1 antibody protein product comprises such regions.

In exemplary embodiments, the anti-PD-1 antibody (or antigen binding antibody fragment thereof comprises a pair of variant sequences having at least or about 70% (e.g., at least about 80%, at least about 90%, at least about 95%) sequence identity to any of SEQ ID NOs: 320, 321, 330, 331, 340, 341, 350, 351, 360, 361, 370, 371, 380, 381, 390, and 391. In exemplary instances, the anti-PD-1 antibody (or antigen binding antibody fragment thereof) comprises a pair of variant sequences which have at least or about 70% (e.g., at least about 80%, at least about 90%, at least about 95%) sequence identity to (a) SEQ ID NOs: 320 and 321; (b) SEQ ID NOs: 330 and 331; (c) SEQ ID NOs: 340 and 341; (d) SEQ ID NOs: 350 and 351; (e) SEQ ID NOs: 360 and 361; (f) SEQ ID NOs: 370 and 371; (g) SEQ ID NOs: 380 and 381; and (h) SEQ ID NOs: 390 and 391. In exemplary embodiments, the anti-PD-1 antibody (or antigen binding antibody fragment thereof) comprises a pair of sequences: one sequence of Table E and another sequence which is a variant sequence having at least or about 70% (e.g., at least about 80%, at least about 90%, at least about 95%) sequence identity to any of SEQ ID NOs: 320, 321, 330, 331, 340, 341, 350, 351, 360, 361, 370, 371, 380, 381, 390, and 391. In exemplary embodiments, the anti-PD-1 antibody (or antigen binding antibody fragment thereof) comprises a pair of sequences: one sequence selected from (a) SEQ ID NOs: 320 and 321; (b) SEQ ID NOs: 330 and 331; (c) SEQ ID NOs: 340 and 341; (d) SEQ ID NOs: 350 and 351; (e) SEQ ID NOs: 360 and 361; (f) SEQ ID NOs: 370 and 371; (g) SEQ ID NOs: 380 and 381; and (h) SEQ ID NOs: 390 and 391, and another sequence which is a variant sequence having at least or about 70% (e.g., at least about 80%, at least about 90%, at least about 95%) sequence identity to a sequence of (a)-(u). For instance, in exemplary aspects, the anti-PD-1 antibody (or antigen binding antibody fragment thereof) comprises the sequence of SEQ ID NO: 320 and further comprises a variant sequence having at least or about 70% (e.g., at least about 80%, at least about 90%, at least about 95%) sequence identity to SEQ ID NO 321. In some embodiments, the anti-PD-1 antibody protein product comprises such regions.

In additional exemplary aspects, the anti-PD-1 antibody, antigen binding antibody fragment thereof, or anti-PD-1 antibody protein product comprises one or more amino acid modifications, relative to the naturally-occurring counterpart, in order to improve half-life/stability or to render the antibody more suitable for expression/manufacturability (e.g., as a fusion protein with the IL-21 mutein). In exemplary instances, the anti-PD-1 antibody is designed to prevent or reduce interaction between the anti-PD-1 antibody and Fc receptors. In exemplary instances, the anti-PD-1 antibody is a Stable Effector Functionless (SEFL) antibody comprising a constant region that lacks the ability to interact with Fcγ receptors. SEFL antibodies are known in the art. See, e.g., Liu et al., J Biol Chem 292: 1876-1883 (2016); and Jacobsen et al., J. Biol. Chem. 292: 1865-1875 (2017). In exemplary aspects, the SEFL antibody comprises one or more of the following mutations, numbered according to the EU system: L242C, A287C, R292C, N297G, V302C, L306C, and/or K334C. In exemplary aspects, the SEFL antibody comprises N297G. In exemplary aspects, the SEFL antibody comprises A287C, N297G, and L306C. In other exemplary aspects, the SEFL antibody comprises R292C, N297G, and V302C (i.e., SEFL2-2).

The anti-PD-1 antibody, antigen binding antibody fragment thereof, or anti-PD-1 antibody protein product may comprise other half-life extension (HLE) modifications. In exemplary instances, the HLE modification occurs in the heavy chain constant region and comprises one or more of the following mutations, numbered according to the EU system: M252Y, S254T, and T256E. In exemplary instances, the anti-PD-1 antibody, antigen binding antibody fragment thereof, or anti-PD-1 antibody protein product comprises one or two of M252Y, S254T, and T256E. In exemplary instances, the anti-PD-1 antibody, antigen binding antibody fragment thereof, or anti-PD-1 antibody protein product comprises all three of M252Y, S254T, and T256E. In exemplary aspects, the heavy chain constant region comprises an amino acid sequence of SEQ ID NO: 545 or SEQ ID NO: 547 or SEQ ID NO: 549 or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 545 or SEQ ID NO: 547 or SEQ ID NO: 549. In exemplary instances, the HLE modification occurs in the heavy chain constant region and comprises one or more of the following mutations, numbered according to the EU system: L309D, Q311H, and N434S. In exemplary instances, the anti-PD-1 antibody, antigen binding antibody fragment thereof, or anti-PD-1 antibody protein product comprises one, two or all three of L309D, Q311H, and N434S. In exemplary instances, the anti-PD-1 antibody, antigen binding antibody fragment thereof, or anti-PD-1 antibody protein product comprises all three of L309D, Q311H, and N434S. In exemplary aspects, the heavy chain constant region comprises an amino acid sequence of SEQ ID NO: 544 or SEQ ID NO: 546 or SEQ ID NO: 548 or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 544 or SEQ ID NO: 546 or SEQ ID NO: 548.

In exemplary aspects, the anti-PD-1 antibody, antigen binding antibody fragment thereof, or anti-PD-1 antibody protein product comprises SEFL2-2 modifications and HLE modifications. In some instances, the HLE modifications comprise one or two or all three of M252Y, S254T, and T256E. In exemplary aspects, the heavy chain constant region comprises an amino acid sequence of SEQ ID NO: 551 or SEQ ID NO: 553 or SEQ ID NO: 555 or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 551 or SEQ ID NO: 553 or SEQ ID NO: 555. In some instances, the HLE modifications comprise one or two or all three of L309D, Q311H, and N434S. In exemplary aspects, the heavy chain constant region comprises an amino acid sequence of SEQ ID NO: 550 or SEQ ID NO: 552 or SEQ ID NO: 554 or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 550 or SEQ ID NO: 552 or SEQ ID NO: 554. In exemplary aspects, the heavy chain additionally comprises charge pair mutations as described below.

In eukaryotic cells, two types of glycosylation reactions occur: (1) N-linked glycosylation, in which glycans are attached to the asparagine of the recognition sequence Asn-X-Thr/Ser, where "X" is any amino acid except proline, and (2) O-linked glycosylation in which glycans are attached to serine or threonine. N-linked glycosylation begins in the Endoplasmic Reticulum (ER), where a complex set of reactions result in the attachment of a core glycan structure made essentially of two GlcNAc residues and three Man residues. The glycan complex formed in the ER is modified by action of enzymes in the Golgi apparatus. If the saccharide is relatively inaccessible to the enzymes, it typically stays in the original HM form. If enzymes can access the saccharide, then many of the Man residues are cleaved off and the saccharide is further modified, resulting in the complex type N-glycans structure. For example, mannosidase-1 located in the cis-Golgi, can cleave or hydrolyze a HM glycan, while fucosyltransferase FUT-8, located in the medial-Golgi, fucosylates the glycan (Hanrue Imai-Nishiya (2007), BMC Biotechnology, 7:84). In exemplary aspects, the anti-PD-1 antibody is N-glycosylated, e.g., comprises one or more sugar moieties (e.g., glycans, saccharides) covalently attached to a specific amino acid of the heavy chain. In alternative aspects, the anti-PD-1 antibody is not glycosylated or does not comprise any sugar moieties (e.g., glycans, saccharides) covalently attached to a specific amino acid of the heavy chain.

In exemplary aspects, the anti-PD-1 antibody comprises a heavy chain constant region comprising an amino acid sequence of SEQ ID NO: 284, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 284. In exemplary aspects, the anti-PD-1 antibody comprises a heavy chain constant region comprising an amino acid sequence of SEQ ID NO: 284, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 284, and further comprises a linker. In exemplary instances, the linker comprises the amino acid sequence of SEQ ID NO: 262. Thus, in some exemplary aspects, the anti-PD-1 antibody comprises a heavy chain constant region amino acid sequence of SEQ ID NO: 287, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 287. In exemplary aspects, the anti-PD-1 antibody comprises a heavy chain constant region comprising an amino acid sequence of SEQ ID NO: 284, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 284, with the C-terminal Lys clipped or removed. In this regard, in some aspects, the anti-PD-1 antibody comprises a heavy chain constant region lacking the C-terminal Lys and comprises the amino acid sequence of SEQ ID NO: 285, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 285. In general, the C-terminal lysine of an antibody undergoes cleavage by carboxypeptidase during expression. A heavy chain constant region lacking the C-terminal Lys advantageously prevents carboxypeptidase to act on the heavy chain of the anti-PD-1 antibody. In exemplary aspects, the anti-PD-1 antibody comprises a heavy chain constant region lacking the C-terminal Lys and further comprises a linker. In exemplary instances, the linker comprises the amino acid sequence of SEQ ID NO: 262. Thus, in some exemplary aspects, the anti-PD-1 antibody comprises a heavy chain constant region amino acid sequence of SEQ ID NO: 286, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 286. In exemplary aspects, the anti-PD-1 antibody comprises a heavy chain constant region comprising an amino acid sequence of SEQ ID NO: 284, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 284, and with one or more SEFL mutations which prevent or reduce interaction between the anti-PD-1 antibody and Fc receptors, including but not limited to L242C, A287C, R292C, N297G, V302C, L306C, and/or K334C. In exemplary aspects, the SEFL mutations are SEFL2-2 mutations: R292C, N297G, and V302C, such that the anti-PD-1 antibody comprises a heavy chain constant region amino acid sequence of SEQ ID NO: 265, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 265. In exemplary aspects, the anti-PD-1 antibody comprises a heavy chain constant region with SEFL2-2 mutations and with the C-terminal Lys clipped or removed. Such a heavy chain constant region may comprise the sequence of SEQ ID NO: 266. In exemplary aspects, the anti-PD-1 antibody comprises a heavy chain constant region with SEFL2-2 mutations, the C-terminal Lys clipped or removed, and a linker. Such a heavy chain constant region may comprise the sequence of SEQ ID NO: 267. In exemplary aspects, the anti-PD-1 antibody comprises a heavy chain constant region with SEFL2-2 mutations and a linker without the C-terminal Lys clipped. Such a heavy chain constant region may comprise the sequence of SEQ ID NO: 282.

In exemplary aspects, the IL-21 mutein is attached to the Fc of the anti-PD-1 antibody. In exemplary aspects, the IL-21 mutein is attached to one of the two heavy chains of the antibody. In exemplary aspects, the IL-21 mutein is attached to the C-terminus of one of the two heavy chains of the antibody.

In exemplary aspects, the fusion protein comprises only one IL-21 mutein (i.e., the fusion protein comprises an IL-21 mutein monomer). In exemplary aspects, the IL-21 mutein is attached to the C-terminus of one of the two heavy chains of the antibody. In exemplary aspects, when the fusion protein comprises only one IL-21 mutein, the Fc of the antibody comprises modifications designed to drive heterodimerization of the two heavy chains (one heavy chain fused to the IL-21 mutein and one heavy chain lacking the IL-21 mutein). Such modifications include Fc mutations such as knobs-into-holes, DuoBodies, Azymetric, charge pair, HA-TF, SEEDbody, and modifications with differential protein A affinity. See, e.g., Spiess et al., Molecular Immunology, 67(2, Part A), 2015, pp. 95-106. Knobs-into-holes mutations include T366W in the first heavy chain, and T366S, L368A, and/or Y407V in the second heavy chain. See, e.g., Ridgway et al., Protein Eng., 9 (1996), pp. 617-621; and Atwell et al., J. Mol. Biol., 270 (1997), pp. 26-35. DuoBody mutations include F405L in the first heavy chain and K409R in the second heavy chain. See, e.g., Labrijn et al., Proc. Natl. Acad. Sci. U.S.A., 110 (2013), pp. 5145-5150. Azymetric mutations include T350V, L351Y, F405A, and/or Y407V in the first heavy chain, and T350V, T366L, K392L, and/or T394W in the second heavy chain. See, e.g., Von Kreudenstein et al., mAbs, 5 (2013), pp. 646-654. HA-TF mutations include S364H and/or F405A in the first heavy chain, and Y349T and/or T394F in the second heavy chain. See, e.g., Moore et al., mAbs, 3 (2011), pp. 546-557. SEEDbody mutations include IgG/A chimera mutations in the first heavy chain and IgG/A chimera mutations in the second heavy chain. See, e.g., Davis et al., Protein Eng. Des. Sel., 23 (2010), pp. 195-202. Differential protein A affinity mutations include H435R in one heavy chain and no mutations in the other heavy chain. See, e.g., U.S. Pat. No. 8,586,713.

In a particular example, the mutations are charge pair mutations. The following are examples of such charge pair mutations, numbered according to the EU system. Charge pair mutations include K409D in the first heavy chain and D399K in the second heavy chain; K392D in the first heavy chain and E356K in the second heavy chain; or both K409D and K392D in the first heavy chain and both D399K and E356K in the second heavy chain (the latter denoted as "VI" herein). See, e.g., Gunasekaran et al., J Biol Chem 285: 19637-19646 (2010). In another particular example, the chair pair mutations include K439D, K392D, and K409D in the first heavy chain; and E356K and D399K in the second heavy chain (denoted as "V103" herein). In yet another particular example, the charge pair mutations include K360E, K370E, K392E, and K409D in the first heavy chain; and E357K and D399K in the second heavy chain (denoted as "V131" herein). Charge pair mutations may also include K370D in the first heavy chain and E357K in the second heavy chain; or all three of K409D, K392D, and K370D in the first heavy chain and all three of D399K, E357K, and E356K in the second heavy chain (the latter denoted as "V4" herein). Additional charge pair mutations also include D221E, P228E, and/or L368E in the first heavy chain and D221R, P228R, and/or K409R in the second heavy chain. See, e.g., Strop et al., J. Mol. Biol., 420 (2012), pp. 204-219.

In embodiments where the fusion protein comprises only one IL-21 mutein (i.e., the fusion protein comprises an IL-21 mutein monomer) and the heavy chain contains the V1 charge pair mutations, the IL-21 mutein may be attached to the heavy chain containing the K409D and K392D mutations (e.g., the IL-21 mutein is attached to a heavy chain comprising SEQ ID NO: 294, 296, or 298), or the heavy chain containing the D399K and E356K mutations (e.g., the IL-21 mutein is attached to a heavy chain comprising SEQ ID NO: 295, 297, or 299. In a specific embodiment, the IL-21 mutein is attached to the heavy chain containing the D399K and E356K mutations.

In embodiments where the fusion protein comprises only one IL-21 mutein (i.e., the fusion protein comprises an IL-21 mutein monomer) and the heavy chain contains the V4 charge pair mutations, the IL-21 mutein may be attached to the heavy chain containing the K409D, K392D, and K370D mutations (e.g., the IL-21 mutein is attached to a heavy chain comprising SEQ ID NO: 288, 290, or 292), or the heavy chain containing the D399K, E357K, and E356K mutations (e.g., the IL-21 mutein is attached to a heavy chain comprising SEQ ID NO: 289, 291. or 293). In a specific embodiment, the IL-21 mutein is attached to the heavy chain containing the D399K, E357K, and E356K mutations.

In embodiments where the fusion protein comprises only one IL-21 mutein (i.e., the fusion protein comprises an IL-21 mutein monomer) and the heavy chain contains the V103 charge pair mutations, the IL-21 mutein may be attached to the heavy chain containing the K439D, K392D, and K409D mutations (e.g., the IL-21 mutein is attached to a heavy chain comprising SEQ ID NO: 472, 474, or 476), or the heavy chain containing the E356K and D399K mutations (e.g., the IL-21 mutein is attached to a heavy chain comprising SEQ ID NO: 473, 475, or 477). In a specific embodiment, the IL-21 mutein is attached to the heavy chain containing the E356K and D399K mutations.

In embodiments where the fusion protein comprises only one IL-21 mutein (i.e., the fusion protein comprises an IL-21 mutein monomer) and the heavy chain contains the V131 charge pair mutations, the IL-21 mutein may be attached to the heavy chain containing the K360E, K370E, K392E, and K409D mutations (e.g., the IL-21 mutein is attached to a heavy chain comprising SEQ ID NO: 478, 480, or 482), or the heavy chain containing the E357K and D399K mutations (e.g., the IL-21 mutein is attached to a heavy chain comprising SEQ ID NO: 479, 481, or 483). In a specific embodiment, the IL-21 mutein is attached to the heavy chain containing the E357K and D399K mutations.

Thus, in exemplary aspects, the anti-PD-1 antibody (or antigen binding antibody fragment thereof) comprises a set of charge pair mutations, as described herein. In particular aspects, the anti-PD-1 antibody (or antigen binding antibody fragment thereof) comprises charge pair mutations selected from V1, V103, and V131 charge pair mutations.

In exemplary aspects, the anti-PD-1 antibody comprises a heavy chain constant region comprising an amino acid sequence of SEQ ID NO: 284, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 284, with one or more charge pair mutations, e.g., the V1, V4, V103, or V131 charge pair mutations. In exemplary aspects, the anti-PD-1 antibody comprises a heavy chain constant region comprising an amino acid sequence of SEQ ID NO: 284, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 284, with V1 charge pair mutations, wherein a first heavy chain constant region comprises K409 and K392D mutations and a second heavy chain constant region comprises D399K and E356K mutations. Such a first heavy chain constant region may comprise the sequence of SEQ ID NO: 294 and such a second heavy chain constant region may comprise the sequence of SEQ ID NO: 295. Such first and second heavy chain constant regions may have the C-terminal Lys clipped or removed such that the first and second heavy chain constant regions may comprise SEQ ID NO: 296 and 297, respectively. Such first and second heavy chain constant regions may have the C-terminal Lys clipped or removed and a linker such that the first and second heavy chain constant regions may comprise SEQ ID NO: 298 and 299, respectively. In exemplary aspects, the anti-PD-1 antibody comprises a heavy chain constant region comprising V1 charge pair mutations and SEFL2-2 mutations. Such a first heavy chain constant region comprising the V1 charge pair mutations and SEFL2-2 mutations may comprise a sequence of SEQ ID NO: 306 and such a second heavy chain constant region comprising the V1 charge pair mutations and SEFL2-2 mutations may comprise a sequence of SEQ ID NO: 307. Additional variations of such first and second heavy chains, including, e.g., heavy chains with the C-terminal Lys clipped or removed (SEQ ID NOs: 308 and 309) and with the C-terminal Lys clipped or removed with a linker (SEQ ID NOs: 310 and 311) are contemplated.

In exemplary aspects, the anti-PD-1 antibody comprises a heavy chain constant region comprising an amino acid sequence of SEQ ID NO: 284, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 284, with V4 charge pair mutations, wherein a first heavy chain constant region comprises K409, K392D, and K370D mutations and a second heavy chain constant region comprises D399K, E356K, and E357K mutations. Such a first heavy chain constant region may comprise the sequence of SEQ ID NO: 288 and such a second heavy chain constant region may comprise the sequence of SEQ ID NO: 289. Such first and second heavy chain constant regions may have the C-terminal Lys clipped or removed such that the first and second heavy chain constant regions may comprise SEQ ID NO: 290 and 291, respectively. Such first and second heavy chain constant regions may have the C-terminal Lys clipped or removed and a linker such that the first and second heavy chain constant regions may comprise SEQ ID NO: 292 and 293, respectively. In exemplary aspects, the anti-PD-1 antibody comprises a heavy chain constant region comprising V4 charge pair mutations and SEFL2-2 mutations. Such a first heavy chain constant region comprising the V4 charge pair mutations and SEFL2-2 mutations may comprise a sequence of SEQ ID NO: 300 and such a second heavy chain constant region comprising the V4 charge pair mutations and SEFL2-2 mutations may comprise a sequence of SEQ ID NO: 301. Additional variations of such first and second heavy chains, including, e.g., heavy chains with the C-terminal Lys clipped (SEQ ID NOs: 302 and 303) and with the C-terminal Lys clipped or removed with a linker (SEQ ID NOs: 304 and 305) are contemplated.

In exemplary aspects, the anti-PD-1 antibody comprises a heavy chain constant region comprising an amino acid sequence of SEQ ID NO: 284, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 284, with V103 charge pair mutations, wherein a first heavy chain constant region comprises the sequence of SEQ ID NO: 484 and a second heavy chain constant region comprises the sequence of SEQ ID NO: 485. Such first and second heavy chain constant regions may have the C-terminal Lys clipped or removed such that the first and second heavy chain constant regions may comprise SEQ ID NO: 486 and 487, respectively. Such first and second heavy chain constant regions may have the C-terminal Lys clipped or removed and a linker such that the first and second heavy chain constant regions may comprise SEQ ID NO: 488 and 489, respectively. In exemplary aspects, the anti-PD-1 antibody comprises a heavy chain constant region comprising V103 charge pair mutations and SEFL2-2 mutations. Such a first heavy chain constant region comprising the V103 charge pair mutations and SEFL2-2 mutations may comprise a sequence of SEQ ID NO: 484 and such a second heavy chain constant region comprising the V103 charge pair mutations and SEFL2-2 mutations may comprise a sequence of SEQ ID NO: 485. Additional variations of such first and second heavy chains, including, e.g., heavy chains with the C-terminal Lys clipped (SEQ ID NOs: 486 and 487) and with the C-terminal Lys clipped or removed with a linker (SEQ ID NOs: 488 and 489) are contemplated.

In exemplary aspects, the anti-PD-1 antibody comprises a heavy chain constant region comprising an amino acid sequence of SEQ ID NO: 284, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 284, with V131 charge pair mutations, wherein a first heavy chain constant region comprises the sequence of SEQ ID NO: 478 and a second heavy chain constant region comprises the sequence of SEQ ID NO: 479. Such first and second heavy chain constant regions may have the C-terminal Lys clipped or removed such that the first and second heavy chain constant regions may comprise SEQ ID NO: 480 and 481, respectively. Such first and second heavy chain constant regions may have the C-terminal Lys clipped or removed and a linker such that the first and second heavy chain constant regions may comprise SEQ ID NO: 482 and 483, respectively. In exemplary aspects, the anti-PD-1 antibody comprises a heavy chain constant region comprising V131 charge pair mutations and SEFL2-2 mutations. Such a first heavy chain constant region comprising the V131 charge pair mutations and SEFL2-2 mutations may comprise a sequence of SEQ ID NO: 490 and such a second heavy chain constant region comprising the V131 charge pair mutations and SEFL2-2 mutations may comprise a sequence of SEQ ID NO: 491. Additional variations of such first and second heavy chains, including, e.g., heavy chains with the C-terminal Lys clipped (SEQ ID NOs: 492 and 493) and with the C-terminal Lys clipped or removed with a linker (SEQ ID NOs: 494 and 495) are contemplated.

In alternative aspects, the fusion protein comprises more than one IL-21 mutein (i.e., the fusion protein comprises an IL-21 mutein dimer or IL-21 mutein multimer). In exemplary alternative aspects, the fusion protein comprises 2, 3, or 4 (or more) IL-21 muteins. In exemplary aspects, when the fusion protein comprises more than one IL-21 mutein, each IL-21 mutein comprises the same structure, e.g., the same amino acid sequence. In exemplary instances, the fusion protein comprises an IL-21 homodimer or IL-21 homomultimer. In alternative aspects, each IL-21 mutein of the fusion protein comprises a different structure, e.g., a different amino acid sequence. In exemplary instances, the fusion protein comprises an IL-21 heterodimer or IL-21 heteromultimer. In exemplary instances, the fusion protein comprises two IL-21 muteins, wherein the first IL-21 mutein is linked to the C-terminus of the first antibody heavy chain, and the second IL-21 mutein is linked to the C-terminus of the second antibody heavy chain. In exemplary aspects, each IL-21 mutein has the same amino acid sequence (e.g., is an IL-21 mutein homodimer). In exemplary aspects, the first IL-21 mutein has a different amino acid sequence relative to the second IL-21 mutein (e.g., is an IL-21 mutein heterodimer).

With regard to the fusion proteins comprising one or more IL-21 muteins, each IL-21 mutein may be attached to one of the heavy chains of the antibody with or without a linker. In exemplary aspects, the IL-21 mutein is attached to the C-terminus of one of the antibody heavy chains via a linker and the linker is a peptide. In exemplary instances, the peptide comprises the amino acid sequence of GGGGS (SEQ ID NO: 262). In alternative aspects, the IL-21 mutein is directly attached to the C-terminus of one of the heavy chains of the antibody without a linker.

In exemplary aspects, the fusion protein comprises only one IL-21 mutein which is directly attached to the C-terminus of one of the heavy chains of the anti-PD-1 antibody. In exemplary aspects, the IL-21 mutein comprises an amino acid substitution listed in Table 4 or a sequence of a SEQ ID NO: listed in Table 4. In exemplary aspects, the IL-21 mutein comprises an amino acid substitution listed in Table 5 or a sequence of a SEQ ID NO: listed in Table 5. In exemplary aspects, the IL-21 mutein comprises the amino acid substitutions listed in Table 7 or a sequence of a SEQ ID NO: listed in Table 7. In exemplary aspects, the IL-21 mutein comprises the amino acid substitutions listed in any one of Tables 6 and 8-14 or a sequence of a SEQ ID NO: listed in these Tables. In exemplary aspects, the IL-21 mutein comprises an amino acid sequence of any of SEQ ID NOs: 159, 161, 238, 241, 242, or 244. In exemplary aspects, the IL-21 mutein is directly attached to the anti-PD-1 antibody and does not comprise a peptide linker.

In exemplary aspects, the fusion protein comprises two IL-21 muteins, each of which is directly attached to the C-terminus of a heavy chain of the anti-PD-1 antibody and each of which have the same amino acid sequence. In exemplary aspects, the IL-21 mutein comprises an amino acid substitution listed in Table 4 or a sequence of a SEQ ID NO: listed in Table 4. In exemplary aspects, the IL-21 mutein comprises an amino acid substitution listed in Table 5 or a sequence of a SEQ ID NO: listed in Table 5. In exemplary aspects, the IL-21 mutein comprises the amino acid substitutions listed in Table 7 or a sequence of a SEQ ID NO: listed in Table 7. In exemplary aspects, the IL-21 mutein comprises the amino acid substitutions listed in any one of Tables 6 and 8-14 or a sequence of a SEQ ID NO: listed in these Tables. In exemplary aspects, the IL-21 mutein comprises an amino acid sequence of any of SEQ ID NOs: 159, 161, 237, 238, 241, and 244. In exemplary aspects, the IL-21 mutein is directly attached to the anti-PD-1 antibody and does not comprise a peptide linker.

In exemplary aspects, the fusion protein comprises an amino acid sequence of an antibody constant region described herein fused to an amino acid sequence of any IL-21 mutein described herein. In exemplary aspects, the fusion protein comprises an amino acid sequence of an antibody constant region described herein, which is not glycosylated, fused to an amino acid sequence of any IL-21 mutein described herein. In exemplary instances, the fusion protein comprises a constant region comprising an amino acid sequence of any one of SEQ ID NOs: 265-267, 282, 284-311, 472-495, and 544-555, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to any one of SEQ ID NOs: 265-267, 282, 284-311, 472-495, and 544-555, fused to an IL-21 mutein comprising any one of SEQ ID NOs: 3-21, 23-56, 58-112, 114-208, 210-222, 224-255, and 283, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 3-21, 23-56, 58-112, 114-208, 210-222, 224-255, and 283. In exemplary aspects, the fusion protein comprises an amino acid sequence of any one of SEQ ID NOs: 268-281, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 268-281.

Figure 4A:
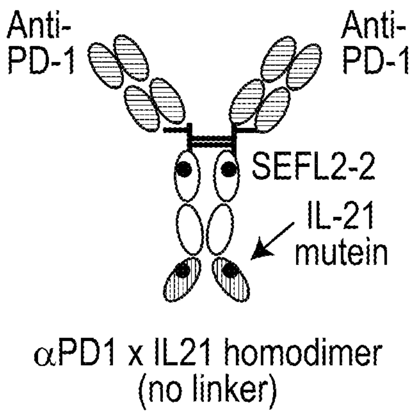
FIG. 4A is an illustration of a fusion protein comprising an anti-PD-1 antibody fused to an IL-21 mutein homodimer. The fusion protein does not have a linker. The antibody may comprise constant regions that reduce or eliminate Fc-associated effector binding and functions (e.g., lack the ability to interact with Fcγ receptors (e.g., SEFL2-2)).
Figure 4B:
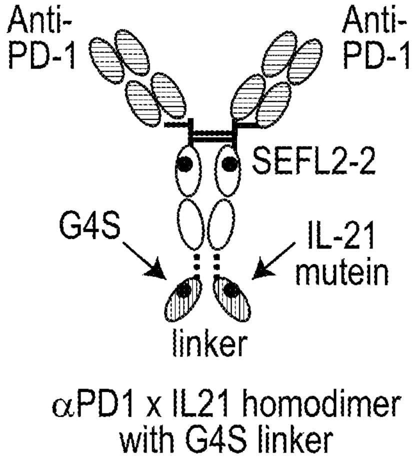
FIG. 4B is an illustration of a fusion protein comprising an anti-PD-1 antibody fused to an IL-21 mutein homodimer. The fusion protein may comprise a GGGGS (G4S) linker between the heavy chain constant region of the antibody and the IL-21 mutein. The antibody may also comprise SEFL2-2 modifications.
Figure 4C:
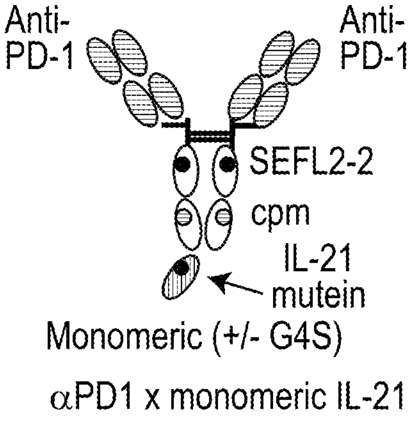
FIG. 4C is an illustration of a fusion protein comprising an anti-PD-1 antibody fused to an IL-21 mutein monomer. The fusion protein may comprise a G4S linker between the heavy chain constant region of the antibody and the IL-21 mutein. The antibody heavy chains comprise charge pair mutations (cpm; e.g., V1, V4, V103, or V131) to aid in preferential association of heterodimer Fc regions. The antibody may also comprise SEFL2-2 modifications.

In exemplary embodiments, the fusion protein comprises a construct as described in FIG. 4A, 4B, or 4C. In exemplary embodiments, the fusion protein comprises (i) an anti-PD-1 antibody (or antigen binding antibody fragment thereof) described herein; and (ii) an IL-21 mutein described herein. In additional exemplary embodiments, the fusion protein comprises (i) an anti-PD-1 antibody (or antigen binding antibody fragment thereof) described herein; (ii) a charge pair mutation described herein; and (iii) an IL-21 mutein described herein (see, e.g., FIG. 4C). In other exemplary embodiments, the fusion protein comprises (i) an anti-PD-1 antibody (or antigen binding antibody fragment thereof) described herein, wherein the heavy chain sequences of said anti-PD-1 antibody (or antigen binding antibody fragment thereof) do not comprise a C-terminal lysine; (ii) a charge pair mutation described herein; and (iii) an IL-21 mutein described herein.

In exemplary instances, the anti-PD-1 antibody (or antigen binding antibody fragment thereof) comprises (a) a heavy chain (HC) complementarity-determining region (CDR) 1 amino acid sequence set forth in Table D or a sequence selected from the group consisting of: SEQ ID NOs: 312, 322, 332, 342, 352, 362, 372, and 382, or a variant sequence thereof which differs by only one or two amino acids or which has at least or about 70% sequence identity; (b) an HC CDR2 amino acid sequence set forth in Table D or a sequence selected from the group consisting of: SEQ ID NOs: 313, 323, 333, 343, 353, 363, 373, and 383, or a variant sequence thereof which differs by only one or two amino acids or which has at least or about 70% sequence identity; (c) an HC CDR3 amino acid sequence set forth in Table D or a sequence selected from the group consisting of: SEQ ID NOs: 314, 324, 334, 344, 354, 364, 374, and 384, or a variant sequence thereof which differs by only one or two amino acids or which has at least or about 70% sequence identity; (d) a light chain (LC) CDR1 amino acid sequence set forth in Table D or a sequence selected from the group consisting of: 315, 325, 335, 345, 355, 365, 375, and 385, or a variant sequence thereof which differs by only one or two amino acids or which has at least or about 70% sequence identity; (e) an LC CDR2 amino acid sequence set forth in Table D or a sequence selected from the group consisting of: 316, 326, 336, 346, 356, 366, 376, and 386, or a variant sequence thereof which differs by only one or two amino acids or which has at least or about 70% sequence identity; (f) an LC CDR3 amino acid sequence set forth in Table D or a sequence selected from the group consisting of: 317, 327, 337, 347, 357, 367, 377, and 387, or a variant sequence thereof which differs by only one or two amino acids or which has at least or about 70% sequence identity; or (g) a combination of any two or more of (a)-(f). In exemplary aspects, the anti-PD-1 antibody (or antigen binding antibody fragment thereof) comprises a LC CDR1 amino acid sequence, a LC CDR2 amino acid sequence, and a LC CDR3 amino acid sequence set forth in Table D and at least 1 or 2 of the HC CDR amino acid sequences set forth in Table D. In exemplary embodiments, the antigen-binding protein comprises 3, 4, 5, or 6 of the amino acid sequences designated by the SEQ ID NOs: in a single column of Table D. In exemplary embodiments, the anti-PD-1 antibody, antigen binding antibody fragment thereof, or anti-PD-1 antibody protein product comprises six CDR amino acid sequences selected from the group consisting of: (a) SEQ ID NOs: 312-317; (b) SEQ ID NOs: 322-327; (c) SEQ ID NOs: 332-337; (d) SEQ ID NOs: 342-347; (e) SEQ ID NOs: 352-357; (f) SEQ ID NOs: 362-367; (g) SEQ ID NOs: 372-377; and (h) SEQ ID NOs: 382-387. In some embodiments, the anti-PD-1 antibody protein product comprises such regions.

In exemplary embodiments, the anti-PD-1 antibody (or antigen binding antibody fragment thereof) comprises (a) a heavy chain variable region amino acid sequence set forth in in Table E or a sequence selected from the group consisting of: 318, 328, 338, 348, 358, 368, 378, and 388, or a variant sequence thereof which differs by only one or two amino acids or which has at least or about 70% sequence identity; or (b) a light chain variable region amino acid sequence set forth in Table E or a sequence selected from the group consisting of: 319, 329, 339, 349, 359, 369, 379, and 389, or a variant sequence thereof which differs by only one or two amino acids or which has at least or about 70% sequence identity; or (c) both (a) and (b). In exemplary embodiments, the anti-PD-1 antibody (or antigen binding antibody fragment thereof) comprises a pair of amino acid sequences selected from the group consisting of: (a) SEQ ID NOs: 318 and 319; (b) SEQ ID NOs: 328 and 329; (c) SEQ ID NOs: 338 and 339; (d) SEQ ID NOs: 348 and 349; (e) SEQ ID NOs: 358 and 359; (f) SEQ ID NOs: 368 and 369; (g) SEQ ID NOs: 378 and 379; and (h) SEQ ID NOs: 388 and 389. In exemplary instances, the antibody constant region comprises an amino acid sequence of any one of SEQ ID NOs: 265-267, 282, and 284-311, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to any one of SEQ ID NOs: 265-267, 282, and 284-311, fused to an IL-21 mutein comprising any one of SEQ ID NOs: 3-21, 23-56, 58-112, 114-208, 210-222, 224-255, and 283, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 3-21, 23-56, 58-112, 114-208, 210-222, 224-255, and 283. In exemplary embodiments, the antigen-binding protein comprises a pair of amino acid sequences selected from the group consisting of: (a) SEQ ID NOs: 320 and 321; (b) SEQ ID NOs: 330 and 331; (c) SEQ ID NOs: 340 and 341; (d) SEQ ID NOs: 350 and 351; (e) SEQ ID NOs: 360 and 361; (f) SEQ ID NOs: 370 and 371; (g) SEQ ID NOs: 380 and 381; and (h) SEQ ID NOs: 390 and 391. In exemplary embodiments, the fusion protein comprises (I) a pair of amino acid sequences selected from the group consisting of: (a) SEQ ID NOs: 320 and 321; (b) SEQ ID NOs: 330 and 331; (c) SEQ ID NOs: 340 and 341; (d) SEQ ID NOs: 350 and 351; (e) SEQ ID NOs: 360 and 361; (f) SEQ ID NOs: 370 and 371; (g) SEQ ID NOs: 380 and 381; and (h) SEQ ID NOs: 390 and 391, and (II) an IL-21 mutein comprising any one of SEQ ID NOs: 3-21, 23-56, 58-112, 114-208, 210-222, 224-255, and 283, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 3-21, 23-56, 58-112, 114-208, 210-222, 224-255, and 283.

In exemplary instances, the fusion protein comprises a homodimer as shown in FIG. 4A, wherein the anti-PD-1 antibody comprises the three light chain CDRs of antibody 20C1.009 (SEQ ID NOs: 355-357), the three heavy chain CDRs of antibody 20C1.009 (SEQ ID NOs: 352-354), and each heavy chain comprises a constant region sequence comprising SEFL2-2 mutations (e.g., SEQ ID NO: 265 or 266), wherein each of the two IL-21 muteins comprises amino acid substitutions R9E and R76A (i.e., each comprises the sequence of SEQ ID NO: 244). In exemplary instances, the anti-PD-1 antibody comprises a heavy chain variable region of SEQ ID NO: 358 and a light chain variable region of SEQ ID NO: 359. In exemplary instances, the anti-PD-1 antibody comprises the heavy chain of SEQ ID NO: 360 or the light chain of SEQ ID NO: 361. In exemplary instances, the fusion protein comprises a homodimer comprising the amino acid sequences of SEQ ID NOs: 361 and 562 or SEQ ID NOs: 361 and 563. In exemplary aspects, the fusion protein comprises a homodimer comprising two antibody light chains (each comprising the amino acid sequence of SEQ ID NO: 361) and two antibody heavy chains (each of which is fused to an IL-21 mutein, and each heavy chain-IL-21 mutein fusion comprises the amino acid sequence of SEQ ID NO: 562). In exemplary aspects, the fusion protein comprises a homodimer comprising two antibody light chains (each comprising the amino acid sequence of SEQ ID NO: 361) and two antibody heavy chains (each of which is fused to an IL-21 mutein, and each heavy chain-IL-21 mutein fusion comprises the amino acid sequence of SEQ ID NO: 563).

In exemplary instances, the fusion protein comprises a homodimer as shown in FIG. 4A, wherein the anti-PD-1 antibody comprises the three light chain CDRs of antibody 20C1.009 (SEQ ID NOs: 355-357), the three heavy chain CDRs of antibody 20C1.009 (SEQ ID NOs: 352-354), and each heavy chain comprises a constant region sequence comprising SEFL2-2 mutations (e.g., SEQ ID NO: 265 or 266), wherein each of the two IL-21 muteins comprises amino acid substitutions R9E and R76E (i.e., each comprises the sequence of SEQ ID NO: 245). In exemplary instances, the anti-PD-1 antibody comprises a heavy chain variable region of SEQ ID NO: 358 and a light chain variable region of SEQ ID NO: 359. In exemplary instances, the anti-PD-1 antibody comprises the heavy chain of SEQ ID NO: 360 or the light chain of SEQ ID NO: 361. In exemplary instances, the fusion protein comprises a homodimer comprising the amino acid sequences of SEQ ID NOs: 361 and 564 or SEQ ID NOs: 361 and 565. In exemplary aspects, the fusion protein comprises a homodimer comprising two antibody light chains (each comprising the amino acid sequence of SEQ ID NO: 361) and two antibody heavy chains (each of which is fused to an IL-21 mutein, and each heavy chain-IL-21 mutein fusion comprises the amino acid sequence of SEQ ID NO: 564). In exemplary aspects, the fusion protein comprises a homodimer comprising two antibody light chains (each comprising the amino acid sequence of SEQ ID NO: 361) and two antibody heavy chains (each of which is fused to an IL-21 mutein, and each heavy chain-IL-21 mutein fusion comprises the amino acid sequence of SEQ ID NO: 565).

In exemplary instances, the fusion protein comprises a homodimer as shown in FIG. 4B, wherein the anti-PD-1 antibody comprises the three light chain CDRs of antibody 20C1.009 (SEQ ID NOs: 355-357), the three heavy chain CDRs of antibody 20C1.009 (SEQ ID NOs: 352-354), and each heavy chain comprises a constant region sequence comprising SEFL2-2 mutations and a linker (e.g., SEQ ID NO: 267), wherein each of the two IL-21 muteins comprises amino acid substitutions R9E and R76A (i.e., each comprises the sequence of SEQ ID NO: 244). In exemplary instances, the anti-PD-1 antibody comprises a heavy chain variable region of SEQ ID NO: 358 and a light chain variable region of SEQ ID NO: 359. In exemplary instances, the anti-PD-1 antibody comprises the heavy chain of SEQ ID NO: 360 or the light chain of SEQ ID NO: 361. In exemplary instances, the fusion protein comprises a homodimer comprising the amino acid sequences of SEQ ID NOs: 361 and 566. In exemplary aspects, the fusion protein comprises a homodimer comprising two antibody light chains (each comprising the amino acid sequence of SEQ ID NO: 361) and two antibody heavy chains (each of which is fused to an IL-21 mutein, and each heavy chain-IL-21 mutein fusion comprises the amino acid sequence of SEQ ID NO: 566).

In exemplary instances, the fusion protein comprises a homodimer as shown in FIG. 4B, wherein the anti-PD-1 antibody comprises the three light chain CDRs of antibody 20C1.009 (SEQ ID NOs: 355-357), the three heavy chain CDRs of antibody 20C1.009 (SEQ ID NOs: 352-354), and each heavy chain comprises a constant region sequence comprising SEFL2-2 mutations and a linker (e.g., SEQ ID NO: 267), wherein each of the two IL-21 muteins comprises amino acid substitutions R9E and R76E (i.e., each comprises the sequence of SEQ ID NO: 245). In exemplary instances, the anti-PD-1 antibody comprises a heavy chain variable region of SEQ ID NO: 358 and a light chain variable region of SEQ ID NO: 359. In exemplary instances, the anti-PD-1 antibody comprises the heavy chain of SEQ ID NO: 360 or the light chain of SEQ ID NO: 361. In exemplary instances, the fusion protein comprises a homodimer comprising the amino acid sequences of SEQ ID NOs: 361 and 567. In exemplary aspects, the fusion protein comprises a homodimer comprising two antibody light chains (each comprising the amino acid sequence of SEQ ID NO: 361) and two antibody heavy chains (each of which is fused to an IL-21 mutein, and each heavy chain-IL-21 mutein fusion comprises the amino acid sequence of SEQ ID NO: 567).

In exemplary instances, the fusion protein comprises an IL-21 mutein monomer as shown in FIG. 4C, wherein the anti-PD-1 antibody comprises the three light chain CDRs of antibody 20C1.009 (SEQ ID NOs: 355-357), the three heavy chain CDRs of antibody 20C1.009 (SEQ ID NOs: 352-354), and a pair of heavy chains comprising constant region sequences comprising SEFL2-2 mutations and V1 charge pair mutations (e.g., SEQ ID NOs: 306 and 307 or SEQ ID NOs: 308 and 309), wherein the IL-21 mutein monomer is attached to the heavy chain which contains the E356K and D399K V1 charge pair mutations (e.g., the IL-21 mutein monomer is attached to a heavy chain comprising any one of SEQ ID NOs: 309), and wherein the IL-21 mutein comprises amino acid substitutions R9E and R76A (i.e., comprises the sequence of SEQ ID NO: 244). In exemplary instances, the anti-PD-1 antibody comprises a heavy chain variable region of SEQ ID NO: 358 and a light chain variable region of SEQ ID NO: 359. In exemplary instances, the anti-PD-1 antibody comprises the heavy chain of SEQ ID NO: 360 or the light chain of SEQ ID NO: 361. In exemplary instances, the fusion protein comprises a monomer comprising the amino acid sequences of SEQ ID NOs: 361 and 568. In exemplary aspects, the fusion protein comprises a monomer comprising two antibody light chains (each comprising the amino acid sequence of SEQ ID NO: 361) and two different antibody heavy chains (one of which is fused to an IL-21 mutein and comprises the amino acid sequence of SEQ ID NO: 568 and one of which is not fused to an IL-21 mutein and comprises the amino acid sequence of SEQ ID NO: 574).

In exemplary instances, the fusion protein comprises an IL-21 mutein monomer as shown in FIG. 4C, wherein the anti-PD-1 antibody comprises the three light chain CDRs of antibody 20C1.009 (SEQ ID NOs: 355-357), the three heavy chain CDRs of antibody 20C1.009 (SEQ ID NOs: 352-354), and a pair of heavy chains comprising constant region sequences comprising SEFL2-2 mutations and V103 charge pair mutations (e.g., SEQ ID NOs: 484 and 485 or SEQ ID NOs: 486 and 487), wherein the IL-21 mutein monomer is attached to the heavy chain which contains the E356K and D399K V103 charge pair mutations (e.g.i.e., the IL-21 mutein monomer is attached to a heavy chain comprising SEQ ID NOs: 487), and wherein the IL-21 mutein comprises amino acid substitutions R9E and R76A (i.e., comprises the sequence of SEQ ID NO: 244). In exemplary instances, the anti-PD-1 antibody comprises a heavy chain variable region of SEQ ID NO: 358 and a light chain variable region of SEQ ID NO: 359. In exemplary instances, the anti-PD-1 antibody comprises the heavy chain of SEQ ID NO: 360 or the light chain of SEQ ID NO: 361. In exemplary instances, the fusion protein comprises a monomer comprising the amino acid sequences of SEQ ID NOs: 361 and 569. In exemplary aspects, the fusion protein comprises a monomer comprising two antibody light chains (each comprising the amino acid sequence of SEQ ID NO: 361) and two different antibody heavy chains (one of which is fused to an IL-21 mutein and comprises the amino acid sequence of SEQ ID NO: 569 and one of which is not fused to an IL-21 mutein and comprises the amino acid sequence of SEQ ID NO: 575).

In exemplary instances, the fusion protein comprises an IL-21 mutein monomer as shown in FIG. 4C, wherein the anti-PD-1 antibody comprises the three light chain CDRs of antibody 20C1.009 (SEQ ID NOs: 355-357), the three heavy chain CDRs of antibody 20C1.009 (SEQ ID NOs: 352-354), and a pair of heavy chains comprising constant region sequences comprising SEFL2-2 mutations and V131 charge pair mutations (e.g., SEQ ID NOs: 490 and 491 or SEQ ID NOs: 492 and 493), wherein the IL-21 mutein monomer is attached to the heavy chain which contains the E357K and D399K V131 charge pair mutations (e.g., the IL-21 mutein monomer is attached to a heavy chain comprising SEQ ID NOs: 493), and wherein the IL-21 mutein comprises amino acid substitutions R9E and R76A (i.e., comprises the sequence of SEQ ID NO: 244). In exemplary instances, the anti-PD-1 antibody comprises a heavy chain variable region of SEQ ID NO: 358 and a light chain variable region of SEQ ID NO: 359. In exemplary instances, the anti-PD-1 antibody comprises the heavy chain of SEQ ID NO: 360 or the light chain of SEQ ID NO: 361. In exemplary instances, the fusion protein comprises a monomer comprising the amino acid sequences of SEQ ID NOs: 361 and 570. In exemplary aspects, the fusion protein comprises a monomer comprising two antibody light chains (each comprising the amino acid sequence of SEQ ID NO: 361) and two different antibody heavy chains (one of which is fused to an IL-21 mutein and comprises the amino acid sequence of SEQ ID NO: 570 and one of which is not fused to an IL-21 mutein and comprises the amino acid sequence of SEQ ID NO: 576).

In exemplary instances, the fusion protein comprises an IL-21 mutein monomer as shown in FIG. 4C, wherein the anti-PD-1 antibody comprises the three light chain CDRs of antibody 20C1.009 (SEQ ID NOs: 355-357), the three heavy chain CDRs of antibody 20C1.009 (SEQ ID NOs: 352-354), and a pair of heavy chains comprising constant region sequences comprising SEFL2-2 mutations and V1 charge pair mutations (e.g., SEQ ID NOs: 306 and 307 or SEQ ID NOs: 308 and 309), wherein the IL-21 mutein monomer is attached to the heavy chain which contains the E356K and D399K V1 charge pair mutations (e.g., the IL-21 mutein monomer is attached to a heavy chain comprising SEQ ID NOs: 309), and wherein the IL-21 mutein comprises amino acid substitutions R9E and R76E (i.e., comprises the sequence of SEQ ID NO: 245). In exemplary instances, the anti-PD-1 antibody comprises a heavy chain variable region of SEQ ID NO: 358 and a light chain variable region of SEQ ID NO: 359. In exemplary instances, the anti-PD-1 antibody comprises the heavy chain of SEQ ID NO: 360 or the light chain of SEQ ID NO: 361. In exemplary instances, the fusion protein comprises a monomer comprising the amino acid sequences of SEQ ID NOs: 361 and 571. In exemplary aspects, the fusion protein comprises a monomer comprising two antibody light chains (each comprising the amino acid sequence of SEQ ID NO: 361) and two different antibody heavy chains (one of which is fused to an IL-21 mutein and comprises the amino acid sequence of SEQ ID NO: 571 and one of which is not fused to an IL-21 mutein and comprises the amino acid sequence of SEQ ID NO: 574).

In exemplary instances, the fusion protein comprises an IL-21 mutein monomer as shown in FIG. 4C, wherein the anti-PD-1 antibody comprises the three light chain CDRs of antibody 20C1.009 (SEQ ID NOs: 355-357), the three heavy chain CDRs of antibody 20C1.009 (SEQ ID NOs: 352-354), and a pair of heavy chains comprising constant region sequences comprising SEFL2-2 mutations and V103 charge pair mutations (e.g., SEQ ID NOs: 484 and 485 or SEQ ID NOs: 486 and 487), wherein the IL-21 mutein monomer is attached to the heavy chain which contains the E356K and D399K V103 charge pair mutations (e.g., the IL-21 mutein monomer is attached to a heavy chain comprising SEQ ID NOs: 487), and wherein the IL-21 mutein comprises amino acid substitutions R9E and R76E (i.e., comprises the sequence of SEQ ID NO: 245). In exemplary instances, the anti-PD-1 antibody comprises a heavy chain variable region of SEQ ID NO: 358 and a light chain variable region of SEQ ID NO: 359. In exemplary instances, the anti-PD-1 antibody comprises the heavy chain of SEQ ID NO: 360 or the light chain of SEQ ID NO: 361. In exemplary instances, the fusion protein comprises a monomer comprising the amino acid sequences of SEQ ID NOs: 361 and 572. In exemplary aspects, the fusion protein comprises a monomer comprising two antibody light chains (each comprising the amino acid sequence of SEQ ID NO: 361) and two different antibody heavy chains (one of which is fused to an IL-21 mutein and comprises the amino acid sequence of SEQ ID NO: 572 and one of which is not fused to an IL-21 mutein and comprises the amino acid sequence of SEQ ID NO: 575).

In exemplary instances, the fusion protein comprises an IL-21 mutein monomer as shown in FIG. 4C, wherein the anti-PD-1 antibody comprises the three light chain CDRs of antibody 20C1.009 (SEQ ID NOs: 355-357), the three heavy chain CDRs of antibody 20C1.009 (SEQ ID NOs: 352-354), and a pair of heavy chains comprising constant region sequences comprising SEFL2-2 mutations and V131 charge pair mutations (e.g., SEQ ID NOs: 490 and 491 or SEQ ID NOs: 492 and 493), wherein the IL-21 mutein monomer is attached to the heavy chain which contains the E357K and D399K V1 charge pair mutations (e.g., the IL-21 mutein monomer is attached to a heavy chain comprising SEQ ID NOs: 493), and wherein the IL-21 mutein comprises amino acid substitutions R9E and R76E (i.e., comprises the sequence of SEQ ID NO: 245). In exemplary instances, the anti-PD-1 antibody comprises a heavy chain variable region of SEQ ID NO: 358 and a light chain variable region of SEQ ID NO: 359. In exemplary instances, the anti-PD-1 antibody comprises the heavy chain of SEQ ID NO: 360 or the light chain of SEQ ID NO: 361. In exemplary instances, the fusion protein comprises a monomer comprising the amino acid sequences of SEQ ID NOs: 361 and 573. In exemplary aspects, the fusion protein comprises a monomer comprising two antibody light chains (each comprising the amino acid sequence of SEQ ID NO: 371) and two different antibody heavy chains (one of which is fused to an IL-21 mutein and comprises the amino acid sequence of SEQ ID NO: 573 and one of which is not fused to an IL-21 mutein and comprises the amino acid sequence of SEQ ID NO: 576).

In exemplary instances, the fusion protein comprises a homodimer as shown in FIG. 4A, wherein the anti-PD-1 antibody comprises the three light chain CDRs of antibody 22D4.017 (SEQ ID NOs: 385-387), the three heavy chain CDRs of antibody 22D4.017 (SEQ ID NOs: 382-384), and each heavy chain comprises a constant region sequence comprising SEFL2-2 mutations (e.g., SEQ ID NO: 265 or 266), wherein each of the two IL-21 muteins comprises amino acid substitutions R9E and R76A (i.e., each comprises the sequence of SEQ ID NO: 244). In exemplary instances, the anti-PD-1 antibody comprises a heavy chain variable region of SEQ ID NO: 388 and a light chain variable region of SEQ ID NO: 389. In exemplary instances, the anti-PD-1 antibody comprises the heavy chain of SEQ ID NO: 390 or the light chain of SEQ ID NO: 391. In exemplary instances, the fusion protein comprises a homodimer comprising the amino acid sequences of SEQ ID NOs: 389 and 496 or SEQ ID NOs: 389 and 519. In exemplary aspects, the fusion protein comprises a homodimer comprising two antibody light chains (each comprising the amino acid sequence of SEQ ID NO: 391) and two antibody heavy chains (each of which is fused to an IL-21 mutein, and each heavy chain-IL-21 mutein fusion comprises the amino acid sequence of SEQ ID NO: 496). In exemplary aspects, the fusion protein comprises a homodimer comprising two antibody light chains (each comprising the amino acid sequence of SEQ ID NO: 391) and two antibody heavy chains (each of which is fused to an IL-21 mutein, and each heavy chain-IL-21 mutein fusion comprises the amino acid sequence of SEQ ID NO: 519).

In exemplary instances, the fusion protein comprises a homodimer as shown in FIG. 4A, wherein the anti-PD-1 antibody comprises the three light chain CDRs of antibody 22D4.017 (SEQ ID NOs: 385-387), the three heavy chain CDRs of antibody 22D4.017 (SEQ ID NOs: 382-384), and each heavy chain comprises a constant region sequence comprising SEFL2-2 mutations (e.g., SEQ ID NO: 265 or 266), wherein each of the two IL-21 muteins comprises amino acid substitutions R9E and R76E (i.e., each comprises the sequence of SEQ ID NO: 245). In exemplary instances, the anti-PD-1 antibody comprises a heavy chain variable region of SEQ ID NO: 388 and a light chain variable region of SEQ ID NO: 389. In exemplary instances, the anti-PD-1 antibody comprises the heavy chain of SEQ ID NO: 390 or the light chain of SEQ ID NO: 391. In exemplary instances, the fusion protein comprises a homodimer comprising the amino acid sequences of SEQ ID NOs: 389 and 497 or SEQ ID NOs: 389 and 498. In exemplary aspects, the fusion protein comprises a homodimer comprising two antibody light chains (each comprising the amino acid sequence of SEQ ID NO: 391) and two antibody heavy chains (each of which is fused to an IL-21 mutein, and the fused heavy chain-IL-21 mutein comprises the amino acid sequence of SEQ ID NO: 497). In exemplary aspects, the fusion protein comprises a homodimer comprising two antibody light chains (each comprising the amino acid sequence of SEQ ID NO: 391) and two antibody heavy chains (each of which is fused to an IL-21 mutein, and each heavy chain-IL-21 mutein fusion comprises the amino acid sequence of SEQ ID NO: 498).

In exemplary instances, the fusion protein comprises a homodimer as shown in FIG. 4B, wherein the anti-PD-1 antibody comprises the three light chain CDRs of antibody 22D4.017 (SEQ ID NOs: 385-387), the three heavy chain CDRs of antibody 22D4.017 (SEQ ID NOs: 382-384), and each heavy chain comprises a constant region sequence comprising SEFL2-2 mutations and a linker (e.g., SEQ ID NO: 267), wherein each of the two IL-21 muteins comprises amino acid substitutions R9E and R76A (i.e., each comprises the sequence of SEQ ID NO: 244). In exemplary instances, the anti-PD-1 antibody comprises a heavy chain variable region of SEQ ID NO: 388 and a light chain variable region of SEQ ID NO: 389. In exemplary instances, the anti-PD-1 antibody comprises the heavy chain of SEQ ID NO: 390 or the light chain of SEQ ID NO: 391. In exemplary instances, the fusion protein comprises a homodimer comprising the amino acid sequences of SEQ ID NOs: 389 and 499. In exemplary aspects, the fusion protein comprises a homodimer comprising two antibody light chains (each comprising the amino acid sequence of SEQ ID NO: 391) and two antibody heavy chains (each of which is fused to an IL-21 mutein, and each heavy chain-IL-21 mutein fusion comprises the amino acid sequence of SEQ ID NO: 499).

In exemplary instances, the fusion protein comprises a homodimer as shown in FIG. 4B, wherein the anti-PD-1 antibody comprises the three light chain CDRs of antibody 22D4.017 (SEQ ID NOs: 385-387), the three heavy chain CDRs of antibody 22D4.017 (SEQ ID NOs: 382-384), and each heavy chain comprises a constant region sequence comprising SEFL2-2 mutations and a linker (e.g., SEQ ID NO: 267), wherein each of the two IL-21 muteins comprises amino acid substitutions R9E and R76E (i.e., each comprises the sequence of SEQ ID NO: 245). In exemplary instances, the anti-PD-1 antibody comprises a heavy chain variable region of SEQ ID NO: 388 and a light chain variable region of SEQ ID NO: 389. In exemplary instances, the anti-PD-1 antibody comprises the heavy chain of SEQ ID NO: 390 or the light chain of SEQ ID NO: 391. In exemplary instances, the fusion protein comprises a homodimer comprising the amino acid sequences of SEQ ID NOs: 389 and 500. In exemplary aspects, the fusion protein comprises a homodimer comprising two antibody light chains (each comprising the amino acid sequence of SEQ ID NO: 391) and two antibody heavy chains (each of which is fused to an IL-21 mutein, and each heavy chain-IL-21 mutein fusion comprises the amino acid sequence of SEQ ID NO: 500).

In exemplary instances, the fusion protein comprises an IL-21 mutein monomer as shown in FIG. 4C, wherein the anti-PD-1 antibody comprises the three light chain CDRs of antibody 22D4.017 (SEQ ID NOs: 385-387), the three heavy chain CDRs of antibody 22D4.017 (SEQ ID NOs: 382-384), and a pair of heavy chains comprising constant region sequences comprising SEFL2-2 mutations and V1 charge pair mutations (e.g., SEQ ID NOs: 306 and 307 or SEQ ID NOs: 308 and 309), wherein the IL-21 mutein monomer is attached to the heavy chain which contains the E356K and D399K V1 charge pair mutations (e.g., the IL-21 mutein monomer is attached to a heavy chain comprising SEQ ID NOs: 309), and wherein the IL-21 mutein comprises amino acid substitutions R9E and R76A (i.e., comprises the sequence of SEQ ID NO: 244). In exemplary instances, the anti-PD-1 antibody comprises a heavy chain variable region of SEQ ID NO: 388 and a light chain variable region of SEQ ID NO: 389. In exemplary instances, the anti-PD-1 antibody comprises the heavy chain of SEQ ID NO: 390 or the light chain of SEQ ID NO: 391. In exemplary instances, the fusion protein comprises a monomer comprising the amino acid sequences of SEQ ID NOs: 389 and 501. In exemplary aspects, the fusion protein comprises a monomer comprising two antibody light chains (each comprising the amino acid sequence of SEQ ID NO: 391) and two different antibody heavy chains (one of which is fused to an IL-21 mutein and comprises the amino acid sequence of SEQ ID NO: 501, and one of which is not fused to an IL-21 mutein and comprises the amino acid sequence of SEQ ID NO: 556).

In exemplary instances, the fusion protein comprises an IL-21 mutein monomer as shown in FIG. 4C, wherein the anti-PD-1 antibody comprises the three light chain CDRs of antibody 22D4.017 (SEQ ID NOs: 385-387), the three heavy chain CDRs of antibody 22D4.017 (SEQ ID NOs: 382-384), and a pair of heavy chains comprising constant region sequences comprising SEFL2-2 mutations and V103 charge pair mutations (e.g., SEQ ID NOs: 484 and 485 or SEQ ID NOs: 486 and 487), wherein the IL-21 mutein monomer is attached to the heavy chain which contains the E356K and D399K V103 charge pair mutations (e.g., the IL-21 mutein monomer is attached to a heavy chain comprising SEQ ID NOs: 487), and wherein the IL-21 mutein comprises amino acid substitutions R9E and R76A (i.e., comprises the sequence of SEQ ID NO: 244). In exemplary instances, the anti-PD-1 antibody comprises a heavy chain variable region of SEQ ID NO: 388 and a light chain variable region of SEQ ID NO: 389. In exemplary instances, the anti-PD-1 antibody comprises the heavy chain of SEQ ID NO: 390 or the light chain of SEQ ID NO: 391. In exemplary instances, the fusion protein comprises a monomer comprising the amino acid sequences of SEQ ID NOs: 389 and 502. In exemplary aspects, the fusion protein comprises a monomer comprising two antibody light chains (each comprising the amino acid sequence of SEQ ID NO: 391) and two different antibody heavy chains (one of which is fused to an IL-21 mutein and comprises the amino acid sequence of SEQ ID NO: 502 and one of which is not fused to an IL-21 mutein and comprises the amino acid sequence of SEQ ID NO: 557).

In exemplary instances, the fusion protein comprises an IL-21 mutein monomer as shown in FIG. 4C, wherein the anti-PD-1 antibody comprises the three light chain CDRs of antibody 22D4.017 (SEQ ID NOs: 385-387), the three heavy chain CDRs of antibody 22D4.017 (SEQ ID NOs: 382-384), and a pair of heavy chains comprising constant region sequences comprising SEFL2-2 mutations and V131 charge pair mutations (e.g., SEQ ID NOs: 490 and 491 or SEQ ID NOs: 492 and 493), wherein the IL-21 mutein monomer is attached to the heavy chain which contains the E357K and D399K V131 charge pair mutations (e.g., the IL-21 mutein monomer is attached to a heavy chain comprising SEQ ID NOs: 493), and wherein the IL-21 mutein comprises amino acid substitutions R9E and R76A (i.e., comprises the sequence of SEQ ID NO: 244). In exemplary instances, the anti-PD-1 antibody comprises a heavy chain variable region of SEQ ID NO: 388 and a light chain variable region of SEQ ID NO: 389. In exemplary instances, the anti-PD-1 antibody comprises the heavy chain of SEQ ID NO: 390 or the light chain of SEQ ID NO: 391. In exemplary instances, the fusion protein comprises a monomer comprising the amino acid sequences of SEQ ID NOs: 389 and 503. In exemplary aspects, the fusion protein comprises a monomer comprising two antibody light chains (each comprising the amino acid sequence of SEQ ID NO: 391) and two different antibody heavy chains (one of which is fused to an IL-21 mutein and comprises the amino acid sequence of SEQ ID NO: 503 and one of which is not fused to an IL-21 mutein and comprises the amino acid sequence of SEQ ID NO: 558).

In exemplary instances, the fusion protein comprises an IL-21 mutein monomer as shown in FIG. 4C, wherein the anti-PD-1 antibody comprises the three light chain CDRs of antibody 22D4.017 (SEQ ID NOs: 385-387), the three heavy chain CDRs of antibody 22D4.017 (SEQ ID NOs: 382-384), and a pair of heavy chains comprising constant region sequences comprising SEFL2-2 mutations and V1 charge pair mutations (e.g., SEQ ID NOs: 306 and 307 or SEQ ID NOs: 308 and 309), wherein the IL-21 mutein monomer is attached to the heavy chain which contains the E356K and D399K V1 charge pair mutations (e.g., the IL-21 mutein monomer is attached to a heavy chain comprising SEQ ID NOs: 309), and wherein the IL-21 mutein comprises amino acid substitutions R9E and R76E (i.e., comprises the sequence of SEQ ID NO: 245). In exemplary instances, the anti-PD-1 antibody comprises a heavy chain variable region of SEQ ID NO: 388 and a light chain variable region of SEQ ID NO: 389. In exemplary instances, the anti-PD-1 antibody comprises the heavy chain of SEQ ID NO: 390 or the light chain of SEQ ID NO: 391. In exemplary instances, the fusion protein comprises a monomer comprising the amino acid sequences of SEQ ID NOs: 389 and 504. In exemplary aspects, the fusion protein comprises a monomer comprising two antibody light chains (each comprising the amino acid sequence of SEQ ID NO: 391) and two different antibody heavy chains (one of which is fused to an IL-21 mutein and comprises the amino acid sequence of SEQ ID NO: 504 and one of which is not fused to an IL-21 mutein and comprises the amino acid sequence of SEQ ID NO: 556).

In exemplary instances, the fusion protein comprises an IL-21 mutein monomer as shown in FIG. 4C, wherein the anti-PD-1 antibody comprises the three light chain CDRs of antibody 22D4.017 (SEQ ID NOs: 385-387), the three heavy chain CDRs of antibody 22D4.017 (SEQ ID NOs: 382-384), and a pair of heavy chains comprising constant region sequences comprising SEFL2-2 mutations and V103 charge pair mutations (e.g., SEQ ID NOs: 484 and 485 or SEQ ID NOs: 486 and 487), wherein the IL-21 mutein monomer is attached to the heavy chain which contains the E356K and D399K V103 charge pair mutations (e.g., the IL-21 mutein monomer is attached to a heavy chain comprising SEQ ID NOs: 487), and wherein the IL-21 mutein comprises amino acid substitutions R9E and R76E (i.e., comprises the sequence of SEQ ID NO: 245). In exemplary instances, the anti-PD-1 antibody comprises a heavy chain variable region of SEQ ID NO: 388 and a light chain variable region of SEQ ID NO: 389. In exemplary instances, the anti-PD-1 antibody comprises the heavy chain of SEQ ID NO: 390 or the light chain of SEQ ID NO: 391. In exemplary instances, the fusion protein comprises a monomer comprising the amino acid sequences of SEQ ID NOs: 389 and 505. In exemplary aspects, the fusion protein comprises a monomer comprising two antibody light chains (each comprising the amino acid sequence of SEQ ID NO: 391) and two different antibody heavy chains (one of which is fused to an IL-21 mutein and comprises the amino acid sequence of SEQ ID NO: 505 and one of which is not fused to an IL-21 mutein and comprises the amino acid sequence of SEQ ID NO: 557).

In exemplary instances, the fusion protein comprises an IL-21 mutein monomer as shown in FIG. 4C, wherein the anti-PD-1 antibody comprises the three light chain CDRs of antibody 22D4.017 (SEQ ID NOs: 385-387), the three heavy chain CDRs of antibody 22D4.017 (SEQ ID NOs: 382-384), and a pair of heavy chains comprising constant region sequences comprising SEFL2-2 mutations and V131 charge pair mutations (e.g., SEQ ID NOs: 490 and 491 or SEQ ID NOs: 492 and 493), wherein the IL-21 mutein monomer is attached to the heavy chain which contains the E357K and D399K V131 charge pair mutations (e.g., the IL-21 mutein monomer is attached to a heavy chain comprising any one of SEQ ID NOs: 493), and wherein the IL-21 mutein comprises amino acid substitutions R9E and R76E (i.e., comprises the sequence of SEQ ID NO: 245). In exemplary instances, the anti-PD-1 antibody comprises a heavy chain variable region of SEQ ID NO: 388 and a light chain variable region of SEQ ID NO: 389. In exemplary instances, the anti-PD-1 antibody comprises the heavy chain of SEQ ID NO: 390 or the light chain of SEQ ID NO: 391. In exemplary instances, the fusion protein comprises a monomer comprising the amino acid sequences of SEQ ID NOs: 389 and 506. In exemplary aspects, the fusion protein comprises a monomer comprising two antibody light chains (each comprising the amino acid sequence of SEQ ID NO: 391) and two different antibody heavy chains (one of which is fused to an IL-21 mutein and comprises the amino acid sequence of SEQ ID NO: 506 and one of which is not fused to an IL-21 mutein and comprises the amino acid sequence of SEQ ID NO: 558).

In exemplary instances, the fusion protein comprises a homodimer as shown in FIG. 4A, wherein the anti-PD-1 antibody comprises the three light chain CDRs of antibody 20A2.003 (SEQ ID NOs: 365-367), the three heavy chain CDRs of antibody 20A2.003 (SEQ ID NOs: 362-364), and each heavy chain comprises a constant region sequence comprising SEFL2-2 mutations (e.g., SEQ ID NO: 265 or 266), wherein each of the two IL-21 muteins comprises amino acid substitutions R9E and R76A (i.e., each comprises the sequence of SEQ ID NO: 244). In exemplary instances, the anti-PD-1 antibody comprises a heavy chain variable region of SEQ ID NO: 368 and a light chain variable region of SEQ ID NO: 369. In exemplary instances, the anti-PD-1 antibody comprises the heavy chain of SEQ ID NO: 370 or the light chain of SEQ ID NO: 371. In exemplary instances, the fusion protein comprises a homodimer comprising the amino acid sequences of SEQ ID NOs: 369 and 507 or SEQ ID NOs: 369 and 508. In exemplary aspects, the fusion protein comprises a homodimer comprising two antibody light chains (each comprising the amino acid sequence of SEQ ID NO: 371) and two antibody heavy chains (each of which is fused to an IL-21 mutein, and each heavy chain-IL-21 mutein fusion comprises the amino acid sequence of SEQ ID NO: 507). In exemplary aspects, the fusion protein comprises a homodimer comprising two antibody light chains (each comprising the amino acid sequence of SEQ ID NO: 371) and two antibody heavy chains (each of which is fused to an IL-21 mutein, and each heavy chain-IL-21 mutein fusion comprises the amino acid sequence of SEQ ID NO: 508).

In exemplary instances, the fusion protein comprises a homodimer as shown in FIG. 4A, wherein the anti-PD-1 antibody comprises the three light chain CDRs of antibody 20A2.003 (SEQ ID NOs: 365-367), the three heavy chain CDRs of antibody 20A2.003 (SEQ ID NOs: 362-364), and each heavy chain comprises a constant region sequence comprising SEFL2-2 mutations (e.g., SEQ ID NO: 265 or 266), wherein each of the two IL-21 muteins comprises amino acid substitutions R9E and R76E (i.e., each comprises the sequence of SEQ ID NO: 245). In exemplary instances, the anti-PD-1 antibody comprises a heavy chain variable region of SEQ ID NO: 368 and a light chain variable region of SEQ ID NO: 369. In exemplary instances, the anti-PD-1 antibody comprises the heavy chain of SEQ ID NO: 370 or the light chain of SEQ ID NO: 371. In exemplary instances, the fusion protein comprises a homodimer comprising the amino acid sequences of SEQ ID NOs: 369 and 509 or SEQ ID NOs: 369 and 510. In exemplary aspects, the fusion protein comprises a homodimer comprising two antibody light chains (each comprising the amino acid sequence of SEQ ID NO: 371) and two antibody heavy chains (each of which is fused to an IL-21 mutein, and each heavy chain-IL-21 mutein fusion comprises the amino acid sequence of SEQ ID NO: 509). In exemplary aspects, the fusion protein comprises a homodimer comprising two antibody light chains (each comprising the amino acid sequence of SEQ ID NO: 371) and two antibody heavy chains (each of which is fused to an IL-21 mutein, and each heavy chain-IL-21 mutein fusion comprises the amino acid sequence of SEQ ID NO: 510).

In exemplary instances, the fusion protein comprises a homodimer as shown in FIG. 4B, wherein the anti-PD-1 antibody comprises the three light chain CDRs of antibody 20A2.003 (SEQ ID NOs: 365-367), the three heavy chain CDRs of antibody 20A2.003 (SEQ ID NOs: 362-364), and each heavy chain comprises a constant region sequence comprising SEFL2-2 mutations and a linker (e.g., SEQ ID NO: 267), wherein each of the two IL-21 muteins comprises amino acid substitutions R9E and R76A (i.e., each comprises the sequence of SEQ ID NO: 244). In exemplary instances, the anti-PD-1 antibody comprises a heavy chain variable region of SEQ ID NO: 368 and a light chain variable region of SEQ ID NO: 369. In exemplary instances, the anti-PD-1 antibody comprises the heavy chain of SEQ ID NO: 370 or the light chain of SEQ ID NO: 371. In exemplary instances, the fusion protein comprises a homodimer comprising the amino acid sequences of SEQ ID NOs: 369 and 511. In exemplary aspects, the fusion protein comprises a homodimer comprising two antibody light chains (each comprising the amino acid sequence of SEQ ID NO: 371) and two antibody heavy chains (each of which is fused to an IL-21 mutein, and each heavy chain-IL-21 mutein fusion comprises the amino acid sequence of SEQ ID NO: 511).

In exemplary instances, the fusion protein comprises a homodimer as shown in FIG. 4B, wherein the anti-PD-1 antibody comprises the three light chain CDRs of antibody 20A2.003 (SEQ ID NOs: 365-367), the three heavy chain CDRs of antibody 20A2.003 (SEQ ID NOs: 362-364), and each heavy chain comprises a constant region sequence comprising SEFL2-2 mutations and a linker (e.g., SEQ ID NO: 267), wherein each of the two IL-21 muteins comprises amino acid substitutions R9E and R76E (i.e., each comprises the sequence of SEQ ID NO: 245). In exemplary instances, the anti-PD-1 antibody comprises a heavy chain variable region of SEQ ID NO: 368 and a light chain variable region of SEQ ID NO: 369. In exemplary instances, the anti-PD-1 antibody comprises the heavy chain of SEQ ID NO: 370 or the light chain of SEQ ID NO: 371. In exemplary instances, the fusion protein comprises a homodimer comprising the amino acid sequences of SEQ ID NOs: 369 and 512. In exemplary aspects, the fusion protein comprises a homodimer comprising two antibody light chains (each comprising the amino acid sequence of SEQ ID NO: 371) and two antibody heavy chains (each of which is fused to an IL-21 mutein, and each heavy chain-IL-21 mutein fusion comprises the amino acid sequence of SEQ ID NO: 512).

In exemplary instances, the fusion protein comprises an IL-21 mutein monomer as shown in FIG. 4C, wherein the anti-PD-1 antibody comprises the three light chain CDRs of antibody 20A2.003 (SEQ ID NOs: 365-367), the three heavy chain CDRs of antibody 20A2.003 (SEQ ID NOs: 362-364), and a pair of heavy chains comprising constant region sequences comprising SEFL2-2 mutations and V1 charge pair mutations (e.g., SEQ ID NOs: 306 and 307 or SEQ ID NOs: 308 and 309), wherein the IL-21 mutein monomer is attached to the heavy chain which contains the E356K and D399K V1 charge pair mutations (e.g., the IL-21 mutein monomer is attached to a heavy chain comprising any one of SEQ ID NOs: 309), and wherein the IL-21 mutein comprises amino acid substitutions R9E and R76A (i.e., comprises the sequence of SEQ ID NO: 244). In exemplary instances, the anti-PD-1 antibody comprises a heavy chain variable region of SEQ ID NO: 368 and a light chain variable region of SEQ ID NO: 369. In exemplary instances, the anti-PD-1 antibody comprises the heavy chain of SEQ ID NO: 370 or the light chain of SEQ ID NO: 371. In exemplary instances, the fusion protein comprises a monomer comprising the amino acid sequences of SEQ ID NOs: 369 and 513. In exemplary aspects, the fusion protein comprises a monomer comprising two antibody light chains (each comprising the amino acid sequence of SEQ ID NO: 371) and two different antibody heavy chains (one of which is fused to an IL-21 mutein and comprises the amino acid sequence of SEQ ID NO: 513 and one of which is not fused to an IL-21 mutein and comprises the amino acid sequence of SEQ ID NO: 559).

In exemplary instances, the fusion protein comprises an IL-21 mutein monomer as shown in FIG. 4C, wherein the anti-PD-1 antibody comprises the three light chain CDRs of antibody 20A2.003 (SEQ ID NOs: 365-367), the three heavy chain CDRs of antibody 20A2.003 (SEQ ID NOs: 362-364), and a pair of heavy chains comprising constant region sequences comprising SEFL2-2 mutations and V103 charge pair mutations (e.g., SEQ ID NOs: 484 and 485 or SEQ ID NOs: 486 and 487), wherein the IL-21 mutein monomer is attached to the heavy chain which contains the E356K and D399K V103 charge pair mutations (e.g., the IL-21 mutein monomer is attached to a heavy chain comprising SEQ ID NOs: 487), and wherein the IL-21 mutein comprises amino acid substitutions R9E and R76A (i.e., comprises the sequence of SEQ ID NO: 244). In exemplary instances, the anti-PD-1 antibody comprises a heavy chain variable region of SEQ ID NO: 368 and a light chain variable region of SEQ ID NO: 369. In exemplary instances, the anti-PD-1 antibody comprises the heavy chain of SEQ ID NO: 370 or the light chain of SEQ ID NO: 371. In exemplary instances, the fusion protein comprises a monomer comprising the amino acid sequences of SEQ ID NOs: 369 and 514. In exemplary aspects, the fusion protein comprises a monomer comprising two antibody light chains (each comprising the amino acid sequence of SEQ ID NO: 371) and two different antibody heavy chains (one of which is fused to an IL-21 mutein and comprises the amino acid sequence of SEQ ID NO: 514 and one of which is not fused to an IL-21 mutein and comprises the amino acid sequence of SEQ ID NO: 560).

In exemplary instances, the fusion protein comprises an IL-21 mutein monomer as shown in FIG. 4C, wherein the anti-PD-1 antibody comprises the three light chain CDRs of antibody 20A2.003 (SEQ ID NOs: 365-367), the three heavy chain CDRs of antibody 20A2.003 (SEQ ID NOs: 362-364), and a pair of heavy chains comprising constant region sequences comprising SEFL2-2 mutations and V131 charge pair mutations (e.g., SEQ ID NOs: 490 and 491 or SEQ ID NOs: 492 and 493), wherein the IL-21 mutein monomer is attached to the heavy chain which contains the E357K and D399K V131 charge pair mutations (e.g., the IL-21 mutein monomer is attached to a heavy chain comprising SEQ ID NOs: 493), and wherein the IL-21 mutein comprises amino acid substitutions R9E and R76A (i.e., comprises the sequence of SEQ ID NO: 244). In exemplary instances, the anti-PD-1 antibody comprises a heavy chain variable region of SEQ ID NO: 368 and a light chain variable region of SEQ ID NO: 369. In exemplary instances, the anti-PD-1 antibody comprises the heavy chain of SEQ ID NO: 370 or the light chain of SEQ ID NO: 371. In exemplary instances, the fusion protein comprises a monomer comprising the amino acid sequences of SEQ ID NOs: 369 and 515. In exemplary aspects, the fusion protein comprises a monomer comprising two antibody light chains (each comprising the amino acid sequence of SEQ ID NO: 371) and two different antibody heavy chains (one of which is fused to an IL-21 mutein and comprises the amino acid sequence of SEQ ID NO: 515 and one of which is not fused to an IL-21 mutein and comprises the amino acid sequence of SEQ ID NO: 561).

In exemplary instances, the fusion protein comprises an IL-21 mutein monomer as shown in FIG. 4C, wherein the anti-PD-1 antibody comprises the three light chain CDRs of antibody 20A2.003 (SEQ ID NOs: 365-367), the three heavy chain CDRs of antibody 20A2.003 (SEQ ID NOs: 362-364), and a pair of heavy chains comprising constant region sequences comprising SEFL2-2 mutations and V1 charge pair mutations (e.g., SEQ ID NOs: 306 and 307 or SEQ ID NOs: 308 and 309), wherein the IL-21 mutein monomer is attached to the heavy chain which contains the E356K and D399K V1 charge pair mutations (e.g., the IL-21 mutein monomer is attached to a heavy chain comprising SEQ ID NOs: 309), and wherein the IL-21 mutein comprises amino acid substitutions R9E and R76E (i.e., comprises the sequence of SEQ ID NO: 245). In exemplary instances, the anti-PD-1 antibody comprises a heavy chain variable region of SEQ ID NO: 368 and a light chain variable region of SEQ ID NO: 369. In exemplary instances, the anti-PD-1 antibody comprises the heavy chain of SEQ ID NO: 370 or the light chain of SEQ ID NO: 371. In exemplary instances, the fusion protein comprises a monomer comprising the amino acid sequences of SEQ ID NOs: 369 and 516. In exemplary aspects, the fusion protein comprises a monomer comprising two antibody light chains (each comprising the amino acid sequence of SEQ ID NO: 371) and two different antibody heavy chains (one of which is fused to an IL-21 mutein and comprises the amino acid sequence of SEQ ID NO: 516 and one of which is not fused to an IL-21 mutein and comprises the amino acid sequence of SEQ ID NO: 559).

In exemplary instances, the fusion protein comprises an IL-21 mutein monomer as shown in FIG. 4C, wherein the anti-PD-1 antibody comprises the three light chain CDRs of antibody 20A2.003 (SEQ ID NOs: 365-367), the three heavy chain CDRs of antibody 20A2.003 (SEQ ID NOs: 362-364), and a pair of heavy chains comprising constant region sequences comprising SEFL2-2 mutations and V103 charge pair mutations (e.g., SEQ ID NOs: 484 and 485 or SEQ ID NOs: 486 and 487), wherein the IL-21 mutein monomer is attached to the heavy chain which contains the E356K and D399K V103 charge pair mutations (e.g., the IL-21 mutein monomer is attached to a heavy chain comprising SEQ ID NOs: 487), and wherein the IL-21 mutein comprises amino acid substitutions R9E and R76E (i.e., comprises the sequence of SEQ ID NO: 245). In exemplary instances, the anti-PD-1 antibody comprises a heavy chain variable region of SEQ ID NO: 368 and a light chain variable region of SEQ ID NO: 369. In exemplary instances, the anti-PD-1 antibody comprises the heavy chain of SEQ ID NO: 370 or the light chain of SEQ ID NO: 371. In exemplary instances, the fusion protein comprises a monomer comprising the amino acid sequences of SEQ ID NOs: 369 and 517. In exemplary aspects, the fusion protein comprises a monomer comprising two antibody light chains (each comprising the amino acid sequence of SEQ ID NO: 371) and two different antibody heavy chains (one of which is fused to an IL-21 mutein and comprises the amino acid sequence of SEQ ID NO: 517 and one of which is not fused to an IL-21 mutein and comprises the amino acid sequence of SEQ ID NO: 560).

In exemplary instances, the fusion protein comprises an IL-21 mutein monomer as shown in FIG. 4C, wherein the anti-PD-1 antibody comprises the three light chain CDRs of antibody 20A2.003 (SEQ ID NOs: 365-367), the three heavy chain CDRs of antibody 20A2.003 (SEQ ID NOs: 362-364), and a pair of heavy chains comprising constant region sequences comprising SEFL2-2 mutations and V131 charge pair mutations (e.g., SEQ ID NOs: 490 and 491 or SEQ ID NOs: 492 and 493), wherein the IL-21 mutein monomer is attached to the heavy chain which contains the E357K and D399K V1 charge pair mutations (e.g., the IL-21 mutein monomer is attached to a heavy chain comprising SEQ ID NOs: 493), and wherein the IL-21 mutein comprises amino acid substitutions R9E and R76E (i.e., comprises the sequence of SEQ ID NO: 245). In exemplary instances, the anti-PD-1 antibody comprises a heavy chain variable region of SEQ ID NO: 368 and a light chain variable region of SEQ ID NO: 369. In exemplary instances, the anti-PD-1 antibody comprises the heavy chain of SEQ ID NO: 370 or the light chain of SEQ ID NO: 371. In exemplary instances, the fusion protein comprises a monomer comprising the amino acid sequences of SEQ ID NOs: 369 and 518. In exemplary aspects, the fusion protein comprises a monomer comprising two antibody light chains (each comprising the amino acid sequence of SEQ ID NO: 371) and two different antibody heavy chains (one of which is fused to an IL-21 mutein and comprises the amino acid sequence of SEQ ID NO: 518 and one of which is not fused to an IL-21 mutein and comprises the amino acid sequence of SEQ ID NO: 561).

In exemplary instances, the fusion protein comprises an IL-21 mutein homodimer as shown in FIG. 4A or 4B, or IL-21 mutein monomer as shown in FIG. 4C, and an anti-PD-1 antibody comprising the three light chain CDRs of antibody 20A2.003 (SEQ ID NOs: 365-367), the three heavy chain CDRs of antibody 20A2.003 (SEQ ID NOs: 362-364), and a heavy chain constant region sequence comprising any one of SEQ ID NOs 544-555. In exemplary instances, the fusion protein comprises an IL-21 mutein homodimer as shown in FIG. 4A or 4B, or IL-21 mutein monomer as shown in FIG. 4C, wherein the anti-PD-1 antibody comprises the three light chain CDRs of antibody 20A2.003 (SEQ ID NOs: 365-367), the three heavy chain CDRs of antibody 20A2.003 (SEQ ID NOs: 362-364), and a heavy chain constant region sequence of SEQ ID NO: 525 or 527.

In exemplary instances, the fusion protein comprises an IL-21 mutein homodimer as shown in FIG. 4A or 4B, or IL-21 mutein monomer as shown in FIG. 4C, wherein the anti-PD-1 antibody comprises the three light chain CDRs of antibody 22D4.017 (SEQ ID NOs: 385-387), the three heavy chain CDRs of antibody 22D4.017 (SEQ ID NOs: 382-384), and a heavy chain constant region sequence comprising any one of SEQ ID NOs 544-555. In exemplary instances, the fusion protein comprises an IL-21 mutein homodimer as shown in FIG. 4A or 4B, or IL-21 mutein monomer as shown in FIGS. 4A-4C, wherein the anti-PD-1 antibody comprises the three light chain CDRs of antibody 22D4.017 (SEQ ID NOs: 385-387), the three heavy chain CDRs of antibody 22D4.017 (SEQ ID NOs: 382-384), and a heavy chain constant region sequence of SEQ ID NO 529 or 531.

In exemplary instances, the fusion protein comprises an IL-21 mutein homodimer as shown in FIG. 4A or 4B, or IL-21 mutein monomer as shown in FIG. 4C, wherein the anti-PD-1 antibody comprises the three light chain CDRs of antibody 20C1.009 (SEQ ID NOs: 355-357), the three heavy chain CDRs of antibody 20C1.009 (SEQ ID NOs: 352-354), and a heavy chain constant region sequence comprising any one of SEQ ID NOs 544-555. In exemplary instances, the fusion protein comprises an IL-21 mutein homodimer as shown in FIG. 4A or 4B, or IL-21 mutein monomer as shown in FIG. 4C, wherein the anti-PD-1 antibody comprises the three light chain CDRs of antibody 20C1.009 (SEQ ID NOs: 355-357), the three heavy chain CDRs of antibody 20C1.009 (SEQ ID NOs: 352-354), and a heavy chain constant region sequence of SEQ ID NO 521 or 523.

Antigen-Binding Proteins

The present disclosure provides PD-1 antigen binding proteins. In exemplary aspects, the PD-1 antigen-binding protein is an anti-PD-1 antibody, antigen binding antibody fragment thereof, or anti-PD-1 antibody protein product described herein. In exemplary instances, the anti-PD-1 antibody, antigen binding antibody fragment thereof, or anti-PD-1 antibody protein product comprises (a) a heavy chain (HC) complementarity-determining region (CDR) 1 amino acid sequence set forth in Table D or a sequence selected from the group consisting of: SEQ ID NOs: 312, 322, 332, 342, 352, 362, 372, and 382, or a variant sequence thereof which differs by only one or two amino acids or which has at least or about 70% sequence identity; (b) an HC CDR2 amino acid sequence set forth in Table D or a sequence selected from the group consisting of: SEQ ID NOs: 313, 323, 333, 343, 353, 363, 373, and 383, or a variant sequence thereof which differs by only one or two amino acids or which has at least or about 70% sequence identity; (c) an HC CDR3 amino acid sequence set forth in Table D or a sequence selected from the group consisting of: SEQ ID NOs: 314, 324, 334, 344, 354, 364, 374, and 384, or a variant sequence thereof which differs by only one or two amino acids or which has at least or about 70% sequence identity; (d) a light chain (LC) CDR1 amino acid sequence set forth in Table D or a sequence selected from the group consisting of: 315, 325, 335, 345, 355, 365, 375, and 385, or a variant sequence thereof which differs by only one or two amino acids or which has at least or about 70% sequence identity; (e) an LC CDR2 amino acid sequence set forth in Table D or a sequence selected from the group consisting of: 316, 326, 336, 346, 356, 366, 376, and 386, or a variant sequence thereof which differs by only one or two amino acids or which has at least or about 70% sequence identity; (f) an LC CDR3 amino acid sequence set forth in Table D or a sequence selected from the group consisting of: 317, 327, 337, 347, 357, 367, 377, and 387, or a variant sequence thereof which differs by only one or two amino acids or which has at least or about 70% sequence identity; or (g) a combination of any two or more of (a)-(f). In exemplary aspects, the anti-PD-1 antibody, antigen binding antibody fragment thereof, or anti-PD-1 antibody protein product comprises a LC CDR1 amino acid sequence, a LC CDR2 amino acid sequence, and a LC CDR3 amino acid sequence set forth in Table D and at least 1 or 2 of the HC CDR amino acid sequences set forth in Table D. In exemplary embodiments, the antigen-binding protein comprises at least 3, 4, or 5 of the amino acid sequences designated by the SEQ ID NOs: in a single column of Table D.

In exemplary embodiments, the anti-PD-1 antibody, antigen binding antibody fragment thereof, or anti-PD-1 antibody protein product comprises six CDR amino acid sequences selected from the group consisting of: (a) SEQ ID NOs: 312-317; (b) SEQ ID NOs: 322-327; (c) SEQ ID NOs: 332-337; (d) SEQ ID NOs: 342-347; (e) SEQ ID NOs: 352-357; (f) SEQ ID NOs: 362-367; (g) SEQ ID NOs: 372-377; and (h) SEQ ID NOs: 382-387. In exemplary instances, the amino acid sequences of Table D are separated by at least one or more (e.g., at least 2, 3, 4, 5, 6, 7, 8, 9, 10, or more) intervening amino acid(s). In exemplary embodiments, the anti-PD-1 antibody, antigen binding antibody fragment thereof, or anti-PD-1 antibody protein product comprises (a) a heavy chain variable region amino acid sequence set forth in in Table E or a sequence selected from the group consisting of: 318, 328, 338, 348, 358, 368, 378, and 388, or a variant sequence thereof which differs by only one or two amino acids or which has at least or about 70% sequence identity; or (b) a light chain variable region amino acid sequence set forth in Table E or a sequence selected from the group consisting of: 319, 329, 339, 349, 359, 369, 379, and 389, or a variant sequence thereof which differs by only one or two amino acids or which has at least or about 70% sequence identity; or (c) both (a) and (b). In exemplary embodiments, the anti-PD-1 antibody, antigen binding antibody fragment thereof, or anti-PD-1 antibody protein product comprises a pair of amino acid sequences selected from the group consisting of: (a) SEQ ID NOs: 318 and 319; (b) SEQ ID NOs: 328 and 329; (c) SEQ ID NOs: 338 and 339; (d) SEQ ID NOs: 348 and 349; (e) SEQ ID NOs: 358 and 359; (f) SEQ ID NOs: 368 and 369; (g) SEQ ID NOs: 378 and 379; and (h) SEQ ID NOs: 388 and 389. In exemplary aspects, the anti-PD-1 antibody, antigen binding antibody fragment thereof, or anti-PD-1 antibody protein product comprises (I) a pair of amino acid sequences selected from the group consisting of: (a) SEQ ID NOs: 318 and 319; (b) SEQ ID NOs: 328 and 329; (c) SEQ ID NOs: 338 and 339;

(d) SEQ ID NOs: 348 and 349; (e) SEQ ID NOs: 358 and 359; (f) SEQ ID NOs: 368 and 369; (g) SEQ ID NOs: 378 and 379; and (h) SEQ ID NOs: 388 and 389 and (II) a constant region comprising any one of SEQ ID NOs: 265-267, 282, 284-311, 472-495, and 544-555. In exemplary embodiments, the antigen-binding protein comprises a pair of amino acid sequences selected from the group consisting of: (a) SEQ ID NOs: 320 and 321; (b) SEQ ID NOs: 330 and 331; (c) SEQ ID NOs: 340 and 341; (d) SEQ ID NOs: 350 and 351; (e) SEQ ID NOs: 360 and 361; (f) SEQ ID NOs: 370 and 371; (g) SEQ ID NOs: 380 and 381; and (h) SEQ ID NOs: 390 and 391. In exemplary embodiments, the antigen-binding protein comprises an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to one or more of the SEQ ID NOs: above.

In some embodiments, the antigen binding protein described above is an anti-PD-1 antibody, or an antigen binding antibody fragment thereof.

The present disclosure additionally provides conjugates comprising a PD-1 antigen binding protein described herein and a heterologous moiety. The heterologous moiety may be any molecule which is different from the PD-1 antigen-binding protein described herein. The heterologous moiety, in exemplary aspects, is a heterologous peptide or polypeptide, a targeting agent, a diagnostic label, a polymer, a nucleic acid, a quantum dot, a small molecule, a toxin, a carbohydrate, an amino acid, or other therapeutic or diagnostic agent. In exemplary aspects, the heterologous moiety is an IL-21 mutein as described herein.

The present disclosure additionally provides fusion proteins comprising a PD-1 antigen binding protein described herein and a heterologous polypeptide or peptide. In exemplary aspects, the heterologous polypeptide is an IL-21 mutein as described herein.

Methods of Making Antibodies

Suitable methods of making antibodies, antigen binding antibody fragments, and antibody protein products are known in the art. For instance, standard hybridoma methods for producing antibodies are described in, e.g., Harlow and Lane (eds.), Antibodies: A Laboratory Manual, CSH Press (1988), and CA. Janeway et al. (eds.), Immunobiology, $5^{th}$ Ed., Garland Publishing, New York, N.Y. (2001)). An exemplary method of preparing anti-PD-1 monoclonal antibodies or the present disclosure is provided herein in EXAMPLES.

Depending on the host species, various adjuvants can be used to increase the immunological response leading to greater antibody production by the host. Such adjuvants include but are not limited to Freund's, mineral gels such as aluminum hydroxide, and surface active substances such as lysolecithin, pluronic polyols, polyanions, peptides, oil emulsions, keyhole limpet hemocyanin, and dinitrophenol. BCG (bacilli Calmette-Guerin) and *Corynebacterium parvum* are potentially useful human adjuvants.

Other methods of antibody production are summarized in Table F.

TABLE F

| Technique | Exemplary references |
|---|---|
| EBV-hybridoma methods and Bacteriophage vector expression systems | Haskard and Archer, J. Immunol. Methods, 74(2), 361-67 (1984), Roder et al., Methods Enzymol., 121, 140-67 (1986), and Huse et al., Science, 246, 1275-81 (1989)). |
| methods of producing antibodies in non-human animals | U.S. Pat. Nos. 5,545,806, 5,569,825, and 5,714,352, and U.S. Patent Application Publication No. 2002/0197266 |
| inducing in vivo production in the lymphocyte population or by screening recombinant immunoglobulin libraries or panels of highly specific binding reagents | Orlandi et al (Proc Natl Acad Sci 86: 3833-3837; 1989), and Winter G and Milstein C (Nature 349: 293-299, 1991). |
| methods of producing recombinant proteins | Protein production and purification" Nat Methods 5(2): 135-146 (2008). |
| Phage display | Janeway et al., supra, Huse et al., supra, and U.S. Pat. No. 6,265,150). Related methods also are described in U.S. Pat. No. 5,403,484; U.S. Pat. No. 5,571,698; U.S. Pat. No. 5,837,500; U.S. Pat. No. 5,702,892. The techniques described in U.S. Pat. No. 5,780,279; U.S. Pat. No. 5,821,047; U.S. Pat. No. 5,824,520; U.S. Pat. No. 5,855,885; U.S. Pat. No. 5,858,657; U.S. Pat. No. 5,871,907; U.S. Pat. No. 5,969,108; U.S. Pat. No. 6,057,098; and U.S. Pat. No. 6,225,447 |
| Antibodies can be produced by transgenic mice | U.S. Pat. Nos. 5,545,806 and 5,569,825, and Janeway et al., supra. |

Methods of testing antibodies for the ability to bind to PD-1 regardless of how the antibodies are produced are known in the art and include any antibody-antigen binding assay, such as, for example, radioimmunoassay (RIA), ELISA, Western blot, immunoprecipitation, SPR, and competitive inhibition assays (see, e.g., Janeway et al., infra, and U.S. Patent Application Publication No. 2002/0197266, and the above section relating to competition assays). Other binding assays, e.g., competitive binding assays or competition assays, which test the ability of an antibody to compete with a second antibody for binding to an antigen, or to an epitope thereof, are known in the art and can be used to test the ability of an antibody to bind to PD-1. See, e.g., U.S. Patent Application Publication No. US20140178905, Chand et al., Biologicals 46: 168-171 (2017); Liu et al., Anal Biochem 525: 89-91 (2017); and Goolia et al., J Vet Diagn Invest 29(2): 250-253 (2017). Also, other methods of comparing two antibodies are known in the art, and include, for example, surface plasmon resonance (SPR). SPR can be used to determine the binding constants of the antibody and second antibody and the two binding constants can be compared.

Heterologous Moieties: Polymers, Carbohydrates, Lipids and Therapeutic Agents

In exemplary embodiments, the conjugate of the present disclosure comprises an IL-21 mutein linked to a polymer.

In some embodiments, the polymer is selected from the group consisting of: polyamides, polycarbonates, polyalkylenes and derivatives thereof including, polyalkylene glycols, polyalkylene oxides, polyalkylene terepthalates, polymers of acrylic and methacrylic esters, including poly (methyl methacrylate), poly(ethyl methacrylate), poly (butylmethacrylate), poly(isobutyl methacrylate), poly (hexylmethacrylate), poly(isodecyl methacrylate), poly (lauryl methacrylate), poly(phenyl methacrylate), poly (methyl acrylate), poly(isopropyl acrylate), poly(isobutyl acrylate), and poly(octadecyl acrylate), polyvinyl polymers including polyvinyl alcohols, polyvinyl ethers, polyvinyl esters, polyvinyl halides, poly(vinyl acetate), and polyvinylpyrrolidone, polyglycolides, polysiloxanes, polyurethanes and co-polymers thereof, celluloses including alkyl cellulose, hydroxyalkyl celluloses, cellulose ethers, cellulose esters, nitro celluloses, methyl cellulose, ethyl cellulose, hydroxypropyl cellulose, hydroxy-propyl methyl cellulose, hydroxybutyl methyl cellulose, cellulose acetate, cellulose propionate, cellulose acetate butyrate, cellulose acetate phthalate, carboxylethyl cellulose, cellulose triacetate, and cellulose sulphate sodium salt, polypropylene, polyethylenes including poly(ethylene glycol), poly(ethylene oxide), and poly(ethylene terephthalate), and polystyrene. In specific embodiments, the polymer is a polyalkylene glycol, including, for example, polyethylene glycol (PEG).

In exemplary embodiments, the conjugate of the present disclosure comprises an IL-21 mutein linked to a carbohydrate. In some embodiments, the carbohydrate is a monosaccharide (e.g., glucose, galactose, fructose), a disaccharide (e.g., sucrose, lactose, maltose), an oligosaccharide (e.g., raffinose, stachyose), or a polysaccharide (e.g., starch, amylase, amylopectin, cellulose, chitin, callose, laminarin, xylan, mannan, fucoidan, or galactomannan).

In some embodiments, the heterologous moiety is a lipid. The lipid, in some embodiments, is a fatty acid, eicosanoid, prostaglandin, leukotriene, thromboxane, N-acyl ethanolamine), glycerolipid (e.g., mono-, di-, tri-substituted glycerols), glycerophospholipid (e.g., phosphatidylcholine, phosphatidylinositol, phosphatidylethanolamine, phosphatidylserine), sphingolipid (e.g., sphingosine, ceramide), sterol lipid (e.g., steroid, cholesterol), prenol lipid, saccharolipid, or a polyketide, oil, wax, cholesterol, sterol, fat-soluble vitamin, monoglyceride, diglyceride, triglyceride, a phospholipid.

In exemplary embodiments, the conjugate of the present disclosure comprises an IL-21 mutein linked to a therapeutic agent. The therapeutic agent can be any of those known in the art. In exemplary aspects, the therapeutic agent is an immunotherapy agent insofar as the agent stimulates an immune response. In exemplary aspects, the immunotherapy agent is cancer vaccine. In exemplary aspects, the immunotherapy agent is a monoclonal antibody. In exemplary aspects, the immunotherapy agent is an immune checkpoint inhibitor, e.g., an inhibitor of CTLA4, PD-1, PD-L1. In exemplary instances, the monoclonal antibody is specific for a protein in an immune-checkpoint pathway. The protein of the immune-checkpoint pathway can be, for example, CTLA4, PD-1, PD-L1, B7-H3, B7H4, or TIM3. For instance, the antigen-binding proteins of the present disclosure can be conjugated to atezolizumab, avelumab, ipilimumab, tremelimumab, BMS-936558, MK3475, CT-011, AM-224, MDX-1105, IMP321, MGA271.

In exemplary aspects, the therapeutic agent is a cytokine, lymphokine, growth factor, or hematopoietic factor effective in inhibiting tumor metastasis and/or having an antiproliferative effect on at least one cell population. Such cytokines, lymphokines, growth factors, or other hematopoietic factors include, but are not limited to: M-CSF, GM-CSF, TNF, IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IFN, TNFα, TNF1, TNF2, G-CSF, Meg-CSF, GM-CSF, thrombopoietin, stem cell factor, and erythropoietin. Additional growth factors for use herein include angiogenin, bone morphogenic protein-1, bone morphogenic protein-2, bone morphogenic protein-3, bone morphogenic protein-4, bone morphogenic protein-5, bone morphogenic protein-6, bone morphogenic protein-7, bone morphogenic protein-8, bone morphogenic protein-9, bone morphogenic protein-10, bone morphogenic protein-11, bone morphogenic protein-12, bone morphogenic protein-13, bone morphogenic protein-14, bone morphogenic protein-15, bone morphogenic protein receptor IA, bone morphogenic protein receptor IB, brain derived neurotrophic factor, ciliary neutrophic factor, ciliary neutrophic factor receptor α, cytokine-induced neutrophil chemotactic factor 1, cytokine-induced neutrophil, chemotactic factor 2 α, cytokine-induced neutrophil chemotactic factor 2 β, β endothelial cell growth factor, endothelin 1, epithelial-derived neutrophil attractant, glial cell line-derived neutrophic factor receptor α 1, glial cell line-derived neutrophic factor receptor α 2, growth related protein, growth related protein α, growth related protein β, growth related protein γ, heparin binding epidermal growth factor, hepatocyte growth factor, hepatocyte growth factor receptor, insulin-like growth factor 1, insulin-like growth factor receptor, insulin-like growth factor II, insulin-like growth factor binding protein, keratinocyte growth factor, leukemia inhibitory factor, leukemia inhibitory factor receptor α, nerve growth factor nerve growth factor receptor, neurotrophin-3, neurotrophin-4, pre-B cell growth stimulating factor, stem cell factor, stem cell factor receptor, transforming growth factor α, transforming growth factor β, transforming growth factor β1, transforming growth factor β1.2, transforming growth factor β2, transforming growth factor β3, transforming growth factor β5, latent transforming growth factor β1, transforming growth factor f binding protein I, transforming growth factor f binding protein II, transforming growth factor f binding protein III, tumor necrosis factor receptor type I, tumor necrosis factor receptor type II, urokinase-type plasminogen activator receptor, and chimeric proteins and biologically or immunologically active fragments thereof. In exemplary embodiments, the therapeutic agent comprises an antibody specific for any one of the aforementioned cytokines, lymphokines, growth factors, or other hematopoietic factors.

Nucleic Acids

The present disclosure further provides nucleic acids comprising a nucleotide sequence encoding an IL-21 mutein of the present disclosure, a conjugate comprising an IL-21 mutein, or a fusion protein comprising an IL-21 mutein. For example, the nucleic acid may comprise a nucleotide sequence encoding a heavy chain of an anti-PD-1 antibody followed by a nucleotide sequence encoding an IL-21 mutein of the present disclosure. The nucleotide sequence encoding a heavy chain and the nucleotide sequence encoding the IL-21 mutein may flank a nucleotide sequence encoding a peptide linker comprising the amino acid sequence of GGGGS (SEQ ID NO: 262). In alternative aspects, the nucleic acid does not comprise a nucleotide sequence encoding a peptide linker and the nucleotide sequence encoding a heavy chain of an anti-PD-1 antibody is tandem to the nucleotide sequence encoding an IL-21 mutein of the present disclosure.

In exemplary aspects, the nucleic acid comprises a nucleotide sequence encoding an IL-21 mutein comprising an amino acid sequence of SEQ ID NOs: 3-21, 23-56, 58-112, 114-208, 210-222, 224-255, and 283, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to an amino acid sequence of SEQ ID NOs: 3-21, 23-56, 58-112, 114-208, 210-222, 224-255, and 283.

In exemplary aspects, the nucleic acid comprises a nucleotide sequence encoding a peptide linker of SEQ ID NO: 262 or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 262.

In exemplary aspects, the nucleic acid comprises a nucleotide sequence encoding a fusion protein comprising an amino acid sequence of an antibody constant region described herein fused to an amino acid sequence of any IL-21 mutein described herein. In exemplary instances, the nucleic acid comprises a nucleotide sequence encoding a fusion protein comprising an amino acid sequence of any one of SEQ ID NOs: 265-267, and 282, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to any one of SEQ ID NOs: 265-267, and 282, fused to any one of SEQ ID NOs: 3-21, 23-56, 58-112, 114-208, 210-222, 224-255, and 283, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 3-21, 23-56, 58-112, 114-208, 210-222, 224-255, and 283. In exemplary aspects, the nucleic acid comprises a nucleotide sequence encoding a fusion protein comprising an amino acid sequence of any one of SEQ ID NOs: 268-281, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to SEQ ID NO: 268-281.

In exemplary aspects, the nucleic acid comprises a nucleotide sequence encoding an anti-PD-1 antibody comprising a heavy chain constant region amino acid sequence of any one of SEQ ID NOs: 265-267, 282, 284-311, 472-495 and 544-555, or an amino acid sequence which has at least about 50%, at least about 60%, at least about 70%, at least about 80%, at least about 85%, at least about 90%, or has greater than about 90% (e.g., about 91%, about 92%, about 93%, about 94%, about 95%, about 96%, about 97%, about 98%, or about 99%) sequence identity to any one of SEQ ID NO: 265-267, 282, 284-311, 472-495 and 544-555.

The present disclosure further provides nucleic acids comprising a nucleotide sequence encoding a PD-1 antigen binding protein of the present disclosure. In exemplary aspects, the nucleotide sequence comprises a sequence encoding a heavy chain CDR or light chain CDR, a heavy chain variable region or light chain variable region or heavy chain sequence or light chain sequence. See Table G below. In exemplary instances, the nucleotide sequence comprises any one of SEQ ID NOs: 392-471. The present disclosure further provides pairs of nucleotide sequences comprising (a) SEQ ID NOs: 398 and 399, (b) SEQ ID NOs: 408 and 409, (c) SEQ ID NOs: 418 and 419, (d) SEQ ID NOs: 428 and 429, (e) SEQ ID NOs: 438 and 439, (f) SEQ ID NOs: 448 and 449, (g) SEQ ID NOs: 458 and 459, or (h) SEQ ID NOs: 468 and 469. The present disclosure additionally provides pairs of nucleotide sequences comprising (a) SEQ ID NOs: 400 and 401, (b) SEQ ID NOs: 410 and 411, (c) SEQ ID NOs: 420 and 421, (d) SEQ ID NOs: 430 and 431, (e) SEQ ID NOs: 440 and 441, (f) SEQ ID NOs: 450 and 451, (g) SEQ ID NOs: 460 and 461, or (h) SEQ ID NOs: 470 and 471.

TABLE G

| | 20A2 | 20C1 | 22D4 | 20C1.006 | 20C1.009 | 20A2.003 | 22D4.006 | 22D4.017 |
|---|---|---|---|---|---|---|---|---|
| HC CDR1 | 392 | 402 | 412 | 422 | 432 | 442 | 452 | 462 |
| HC CDR2 | 393 | 403 | 413 | 423 | 433 | 443 | 453 | 463 |
| HC CDR3 | 394 | 404 | 414 | 424 | 434 | 444 | 454 | 464 |
| LC CDR1 | 395 | 405 | 415 | 425 | 435 | 445 | 455 | 465 |
| LC CDR2 | 396 | 406 | 416 | 426 | 436 | 446 | 456 | 466 |
| LC CDR3 | 397 | 407 | 417 | 427 | 437 | 447 | 457 | 467 |
| HC VARIABLE | 398 | 408 | 418 | 428 | 438 | 448 | 458 | 468 |
| LC VARIABLE | 399 | 409 | 419 | 429 | 439 | 449 | 459 | 469 |
| HC FULL LENGTH | 400 | 410 | 420 | 430 | 440 | 450 | 460 | 470 |
| LC FULL LENGTH | 401 | 411 | 421 | 431 | 441 | 451 | 461 | 471 |

In exemplary aspects, the nucleic acid molecule comprises a nucleotide sequence encoding a conjugate or fusion protein of the present disclosure. By “nucleic acid” as used herein includes “polynucleotide,” “oligonucleotide,” and “nucleic acid molecule,” and generally means a polymer of DNA or RNA, or modified forms thereof, which can be single-stranded or double-stranded, synthesized or obtained (e.g., isolated and/or purified) from natural sources, which can contain natural, non-natural or altered nucleotides, and which can contain a natural, non-natural or altered internucleotide linkage, such as a phosphoroamidate linkage or a phosphorothioate linkage, instead of the phosphodiester found between the nucleotides of an unmodified oligonucleotide. The nucleic acid can comprise any nucleotide sequence which encodes any of the antigen-binding proteins or polypeptides of the present disclosure. In some embodiments, the nucleic acid does not comprise any insertions, deletions, inversions, and/or substitutions. In other embodiments, the nucleic acid comprises one or more insertions, deletions, inversions, and/or substitutions.

In some aspects, the nucleic acids of the present disclosure are recombinant. As used herein, the term "recombinant" refers to (i) molecules that are constructed outside living cells by joining natural or synthetic nucleic acid segments to nucleic acid molecules that can replicate in a living cell, or (ii) molecules that result from the replication of those described in (i) above. For purposes herein, the replication can be in vitro replication or in vivo replication.

The nucleic acids in some aspects are constructed based on chemical synthesis and/or enzymatic ligation reactions using procedures known in the art. See, for example, Sambrook et al., supra; and Ausubel et al., supra. For example, a nucleic acid can be chemically synthesized using naturally occurring nucleotides or variously modified nucleotides designed to increase the biological stability of the molecules or to increase the physical stability of the duplex formed upon hybridization (e.g., phosphorothioate derivatives and acridine substituted nucleotides). Examples of modified nucleotides that can be used to generate the nucleic acids include, but are not limited to, 5-fluorouracil, 5-bromouracil, 5-chlorouracil, 5-iodouracil, hypoxanthine, xanthine, 4-acetylcytosine, 5-(carboxyhydroxymethyl) uracil, 5-carboxymethylaminomethyl-2-thiouridme, 5-carboxymethylaminomethyluracil, dihydrouracil, beta-D-galactosylqueosine, inosine, $N^6$-isopentenyladenine, 1-methylguanine, 1-methylinosine, 2,2-dimethylguanine, 2-methyladenine, 2-methylguanine, 3-methylcytosine, 5-methylcytosine, N-substituted adenine, 7-methylguanine, 5-methylammomethyluracil, 5-methoxyaminomethyl-2-thiouracil, beta-D-mannosylqueosine, 5'-methoxycarboxymethyluracil, 5-methoxyuracil, 2-methylthio-$N^6$-isopentenyladenine, uracil-5-oxyacetic acid (v), wybutoxosine, pseudouratil, queosine, 2-thiocytosine, 5-methyl-2-thiouracil, 2-thiouracil, 4-thiouracil, 5-methyluracil, uracil-5-oxyacetic acid methylester, 3-(3-amino-3-N-2-carboxypropyl) uracil, and 2,6-diaminopurine. Alternatively, one or more of the nucleic acids of the present disclosure can be purchased from companies, such as Macromolecular Resources (Fort Collins, Colo.) and Synthegen (Houston, Tex.).

Vectors

The nucleic acids of the present disclosure in some aspects are incorporated into a vector. In this regard, the present disclosure provides vectors comprising any of the presently disclosed nucleic acids. In exemplary aspects, the vector is a recombinant expression vector. For purposes herein, the term "recombinant expression vector" means a genetically-modified oligonucleotide or polynucleotide construct that permits the expression of an mRNA, protein, polypeptide, or peptide by a host cell, when the construct comprises a nucleotide sequence encoding the mRNA, protein, polypeptide, or peptide, and the vector is contacted with the cell under conditions sufficient to have the mRNA, protein, polypeptide, or peptide expressed within the cell. The vectors of the present disclosure are not naturally-occurring as a whole. However, parts of the vectors can be naturally-occurring. The presently disclosed vectors can comprise any type of nucleotides, including, but not limited to DNA and RNA, which can be single-stranded or double-stranded, synthesized or obtained in part from natural sources, and which can contain natural, non-natural or altered nucleotides. The vectors can comprise naturally-occurring or non-naturally-occurring internucleotide linkages, or both types of linkages. In some aspects, the altered nucleotides or non-naturally occurring internucleotide linkages do not hinder the transcription or replication of the vector.

The vector of the present disclosure can be any suitable vector, and can be used to transform or transfect any suitable host. Suitable vectors include those designed for propagation and expansion or for expression or both, such as plasmids and viruses. The vector can be selected from the group consisting of the pUC series (Fermentas Life Sciences), the pBluescript series (Stratagene, LaJolla, Calif.), the pET series (Novagen, Madison, Wis.), the pGEX series (Pharmacia Biotech, Uppsala, Sweden), and the pEX series (Clontech, Palo Alto, Calif.). Bacteriophage vectors, such as λGTIO, λGTI 1, λZapII (Stratagene), λEMBL4, and λNMI 149, also can be used. Examples of plant expression vectors include pBIO1, pBI101.2, pBI101.3, pBI121 and pBIN19 (Clontech). Examples of animal expression vectors include pEUK-C1, pMAM and pMAMneo (Clontech). In some aspects, the vector is a viral vector, e.g., a retroviral vector.

The vectors of the present disclosure can be prepared using standard recombinant DNA techniques described in, for example, Sambrook et al., supra, and Ausubel et al., supra. Constructs of expression vectors, which are circular or linear, can be prepared to contain a replication system functional in a prokaryotic or eukaryotic host cell. Replication systems can be derived, e.g., from CoIE1, 2 t plasmid, λ, SV40, bovine papilloma virus, and the like.

In some aspects, the vector comprises regulatory sequences, such as transcription and translation initiation and termination codons, which are specific to the type of host (e.g., bacterium, fungus, plant, or animal) into which the vector is to be introduced, as appropriate and taking into consideration whether the vector is DNA- or RNA-based.

The vector can include one or more marker genes, which allow for selection of transformed or transfected hosts. Marker genes include biocide resistance, e.g., resistance to antibiotics, heavy metals, etc., complementation in an auxotrophic host to provide prototrophy, and the like. Suitable marker genes for the presently disclosed expression vectors include, for instance, neomycin/G418 resistance genes, hygromycin resistance genes, histidinol resistance genes, tetracycline resistance genes, and ampicillin resistance genes.

The vector can comprise a native or normative promoter operably linked to the nucleotide sequence encoding the polypeptide (including functional portions and functional variants thereof), or to the nucleotide sequence which is complementary to or which hybridizes to the nucleotide sequence encoding the IL-21, conjugate, or fusion protein. The selection of promoters, e.g., strong, weak, inducible, tissue-specific and developmental-specific, is within the ordinary skill of the artisan. Similarly, the combining of a nucleotide sequence with a promoter is also within the skill of the artisan. The promoter can be a non-viral promoter or a viral promoter, e.g., a cytomegalovirus (CMV) promoter, an SV40 promoter, an RSV promoter, and a promoter found in the long-terminal repeat of the murine stem cell virus.

Host Cells

Provided herein are host cells comprising a nucleic acid or vector of the present disclosure. As used herein, the term "host cell" refers to any type of cell that can contain the presently disclosed vector and is capable of producing an expression product encoded by the nucleic acid (e.g., mRNA, protein). The host cell in some aspects is an adherent cell or a suspended cell, i.e., a cell that grows in suspension. The host cell in exemplary aspects is a cultured cell or a primary cell, i.e., isolated directly from an organism, e.g., a human. The host cell can be of any cell type, can originate from any type of tissue, and can be of any developmental stage.

In exemplary aspects, the cell is a eukaryotic cell, including, but not limited to, a yeast cell, filamentous fungi cell, protozoa cell, algae cell, insect cell, or mammalian cell. Such host cells are described in the art. See, e.g., Frenzel, et al., *Front Immunol* 4: 217 (2013). In exemplary aspects, the eukaryotic cells are mammalian cells. In exemplary aspects, the mammalian cells are non-human mammalian cells. In some aspects, the cells are Chinese Hamster Ovary (CHO) cells and derivatives thereof (e.g., CHO-K1, CHO pro-3, CS9), mouse myeloma cells (e.g., NSO, GS-NSO, Sp2/0), cells engineered to be deficient in dihydrofolatereductase (DHFR) activity (e.g., DUKX-X11, DG44), human embryonic kidney 293 (HEK293) cells or derivatives thereof (e.g., HEK293T, HEK293-EBNA), green African monkey kidney cells (e.g., COS cells, VERO cells), human cervical cancer cells (e.g., HeLa), human bone osteosarcoma epithelial cells U2-OS, adenocarcinomic human alveolar basal epithelial cells A549, human fibrosarcoma cells HT1080, mouse brain tumor cells CAD, embryonic carcinoma cells P19, mouse embryo fibroblast cells NIH 3T3, mouse fibroblast cells L929, mouse neuroblastoma cells N2a, human breast cancer cells MCF-7, retinoblastoma cells Y79, human retinoblastoma cells SO-Rb50, human liver cancer cells Hep G2, mouse B myeloma cells J558L, or baby hamster kidney (BHK) cells (Gaillet et al. 2007; Khan, Adv Pharm Bull 3(2): 257-263 (2013)). In a particular embodiment, the host cell is CS9 (a CHO cell line).

For purposes of amplifying or replicating the vector, the host cell is in some aspects is a prokaryotic cell, e.g., a bacterial cell.

Also provided by the present disclosure is a population of cells comprising at least one host cell described herein. The population of cells in some aspects is a heterogeneous population comprising the host cell comprising vectors described, in addition to at least one other cell, which does not comprise any of the vectors. Alternatively, in some aspects, the population of cells is a substantially homogeneous population, in which the population comprises mainly host cells (e.g., consisting essentially of) comprising the vector. The population in some aspects is a clonal population of cells, in which all cells of the population are clones of a single host cell comprising a vector, such that all cells of the population comprise the vector. In exemplary embodiments of the present disclosure, the population of cells is a clonal population comprising host cells comprising a vector as described herein.

Pharmaceutical Compositions

Compositions comprising an IL-21 mutein, a conjugate comprising the IL-21 mutein, a fusion protein comprising the IL-21 mutein and a polypeptide, a PD-1 antigen-binding protein (e.g., an anti-PD-1 antibody), a conjugate comprising the PD-1 antigen-binding protein (e.g., an anti-PD-1 antibody), a fusion protein comprising the PD-1 antigen-binding protein (e.g., an anti-PD-1 antibody), a nucleic acid, vector, or host cell, of the present disclosure, or a combination thereof, are provided herein. The compositions in some aspects comprise the IL-21 mutein, PD-1 antigen-binding protein (e.g., an anti-PD-1 antibody), a conjugate, fusion protein, nucleic acid, vector, or host cell of the present disclosure, or a combination thereof, in isolated and/or purified form. In some aspects, the composition comprises a single type (e.g., structure) of an IL-21 mutein, PD-1 antigen-binding protein (e.g., an anti-PD-1 antibody), a conjugate, fusion protein, nucleic acid, vector, or host cell of the present disclosure, or comprises a combination of two or more different types (e.g., different structures) of IL-21 muteins, PD-1 antigen-binding proteins, conjugates, fusion proteins, nucleic acids, vectors or host cells of the present disclosure.

In exemplary aspects, the composition comprises agents which enhance the chemico-physico features of the IL-21 mutein, PD-1 antigen-binding protein (e.g., an anti-PD-1 antibody), a conjugate, fusion protein, nucleic acid, vector, or host cell, e.g., via stabilizing, for example, the IL-21 mutein or fusion protein at certain temperatures (e.g., room temperature), increasing shelf life, reducing degradation, e.g., oxidation protease mediated degradation, increasing half-life of, for example, the IL-21 mutein or fusion protein, etc. In some aspects, the composition comprises any of the agents disclosed herein as a heterologous moiety or conjugate moiety, optionally, in admixture with the IL-21 muteins, conjugates, fusion proteins, nucleic acids, vectors, or host cells of the present disclosure.

In exemplary aspects of the present disclosure, the composition additionally comprises a pharmaceutically acceptable carrier, diluents, or excipient. In some embodiments, the IL-21 muteins, PD-1 antigen-binding proteins (e.g., an anti-PD-1 antibodies), conjugates, fusion proteins, nucleic acids, vectors, or host cells as presently disclosed (hereinafter referred to as "active agents") is formulated into a pharmaceutical composition comprising the active agent, along with a pharmaceutically acceptable carrier, diluent, or excipient. In this regard, the present disclosure further provides pharmaceutical compositions comprising an active agent (i.e., any of the IL-21 muteins, PD-1 antigen-binding proteins (e.g., an anti-PD-1 antibodies), conjugates, fusion proteins, nucleic acids, vectors, or host cells of the present disclosure), which pharmaceutical composition is intended for administration to a subject, e.g., a mammal.

In some embodiments, the active agent is present in the pharmaceutical composition at a purity level suitable for administration to a patient. In some embodiments, the active agent has a purity level of at least about 90%, about 91%, about 92%, about 93%, about 94%, about 95%, about 96%, about 97%, about 98% or about 99%, and a pharmaceutically acceptable diluent, carrier or excipient. In some embodiments, the compositions contain an active agent at a concentration of about 0.001 to about 30.0 mg/ml.

In exemplary aspects, the pharmaceutical compositions comprise a pharmaceutically acceptable carrier. As used herein, the term "pharmaceutically acceptable carrier" includes any of the standard pharmaceutical carriers, such as a phosphate buffered saline solution, water, emulsions such as an oil/water or water/oil emulsion, and various types of wetting agents. The term also encompasses any of the agents approved by a regulatory agency of the US Federal government or listed in the US Pharmacopeia for use in animals, including humans.

The pharmaceutical composition can comprise any pharmaceutically acceptable ingredients, including, for example, acidifying agents, additives, adsorbents, aerosol propellants, air displacement agents, alkalizing agents, anticaking agents, anticoagulants, antimicrobial preservatives, antioxidants, antiseptics, bases, binders, buffering agents, chelating agents, coating agents, coloring agents, desiccants, detergents, diluents, disinfectants, disintegrants, dispersing agents, dissolution enhancing agents, dyes, emollients, emulsifying agents, emulsion stabilizers, fillers, film forming agents, flavor enhancers, flavoring agents, flow enhancers, gelling agents, granulating agents, humectants, lubricants, mucoadhesives, ointment bases, ointments, oleaginous vehicles, organic bases, pastille bases, pigments, plasticizers, polishing agents, preservatives, sequestering agents, skin penetrants, solubilizing agents, solvents, stabilizing agents, suppository bases, surface active agents, surfactants, suspending agents, sweetening agents, therapeutic agents, thickening agents, tonicity agents, toxicity agents, viscosity-increasing agents, water-absorbing agents, water-miscible cosolvents, water softeners, or wetting agents. See, e.g., the *Handbook of Pharmaceutical Excipients*, Third Edition, A. H. Kibbe (Pharmaceutical Press, London, U K, 2000), which is incorporated by reference in its entirety. *Remington's Pharmaceutical Sciences*, Sixteenth Edition, E. W. Martin (Mack Publishing Co., Easton, Pa., 1980), which is incorporated by reference in its entirety.

In exemplary aspects, the pharmaceutical composition comprises formulation materials that are nontoxic to recipients at the dosages and concentrations employed. In specific embodiments, pharmaceutical compositions comprising an active agent and one or more pharmaceutically acceptable salts; polyols; surfactants; osmotic balancing agents; tonicity agents; anti-oxidants; antibiotics; antimycotics; bulking agents; lyoprotectants; anti-foaming agents; chelating agents; preservatives; colorants; analgesics; or additional pharmaceutical agents. In exemplary aspects, the pharmaceutical composition comprises one or more polyols and/or one or more surfactants, optionally, in addition to one or more excipients, including but not limited to, pharmaceutically acceptable salts; osmotic balancing agents (tonicity agents); anti-oxidants; antibiotics; antimycotics; bulking agents; lyoprotectants; anti-foaming agents; chelating agents; preservatives; colorants; and analgesics.

In certain embodiments, the pharmaceutical composition can contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as bcnzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbatc, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. See, REMINGTON'S PHARMACEUTICAL SCIENCES, 18" Edition, (A. R. Genrmo, ed.), 1990, Mack Publishing Company.

The pharmaceutical compositions can be formulated to achieve a physiologically compatible pH. In some embodiments, the pH of the pharmaceutical composition can be for example between about 4 or about 5 and about 8.0 or about 4.5 and about 7.5 or about 5.0 to about 7.5. In exemplary embodiments, the pH of the pharmaceutical composition is between 5.5 and 7.5.

Routes of Administration

With regard to the present disclosure, the active agent, or pharmaceutical composition comprising the same, can be administered to the subject via any suitable route of administration. For example, the active agent can be administered to a subject via parenteral, nasal, oral, pulmonary, topical, vaginal, or rectal administration. The following discussion on routes of administration is merely provided to illustrate exemplary embodiments and should not be construed as limiting the scope in any way.

Formulations suitable for parenteral administration include aqueous and non-aqueous, isotonic sterile injection solutions, which can contain anti-oxidants, buffers, bacteriostats, and solutes that render the formulation isotonic with the blood of the intended recipient, and aqueous and non-aqueous sterile suspensions that can include suspending agents, solubilizers, thickening agents, stabilizers, and preservatives. The term, "parenteral" means not through the alimentary canal but by some other route such as subcutaneous, intramuscular, intraspinal, or intravenous. The active agent of the present disclosure can be administered with a physiologically acceptable diluent in a pharmaceutical carrier, such as a sterile liquid or mixture of liquids, including water, saline, aqueous dextrose and related sugar solutions, an alcohol, such as ethanol or hexadecyl alcohol, a glycol, such as propylene glycol or polyethylene glycol, dimethylsulfoxide, glycerol, ketals such as 2,2-dimethyl-153-dioxolane-4-methanol, ethers, poly(ethyleneglycol) 400, oils, fatty acids, fatty acid esters or glycerides, or acetylated fatty acid glycerides with or without the addition of a pharmaceutically acceptable surfactant, such as a soap or a detergent, suspending agent, such as pectin, carbomers, methylcellulose, hydroxypropylmethylcellulose, or carboxymethylcellulose, or emulsifying agents and other pharmaceutical adjuvants.

Oils, which can be used in parenteral formulations include petroleum, animal, vegetable, or synthetic oils. Specific examples of oils include peanut, soybean, sesame, cottonseed, corn, olive, petrolatum, and mineral. Suitable fatty acids for use in parenteral formulations include oleic acid, stearic acid, and isostearic acid. Ethyl oleate and isopropyl myristate are examples of suitable fatty acid esters.

Suitable soaps for use in parenteral formulations include fatty alkali metal, ammonium, and triethanolamine salts, and suitable detergents include (a) cationic detergents such as, for example, dimethyl dialkyl ammonium halides, and alkyl pyridinium halides, (b) anionic detergents such as, for example, alkyl, aryl, and olefin sulfonates, alkyl, olefin, ether, and monoglyceride sulfates, and sulfosuccinates, (c) nonionic detergents such as, for example, fatty amine oxides, fatty acid alkanolamides, and polyoxyethylenepolypropylene copolymers, (d) amphoteric detergents such as, for example, alkyl-β-aminopropionates, and 2-alkyl-imidazoline quaternary ammonium salts, and (e) mixtures thereof.

The parenteral formulations in some embodiments contain from about 0.5% to about 25% by weight of the active agent of the present disclosure in solution. Preservatives and buffers can be used. In order to minimize or eliminate irritation at the site of injection, such compositions can contain one or more nonionic surfactants having a hydrophile-lipophile balance (HLB) of from about 12 to about 17. The quantity of surfactant in such formulations will typically range from about 5% to about 15% by weight. Suitable surfactants include polyethylene glycol sorbitan fatty acid esters, such as sorbitan monooleate and the high molecular weight adducts of ethylene oxide with a hydrophobic base, formed by the condensation of propylene oxide with propylene glycol. The parenteral formulations in some aspects are presented in unit-dose or multi-dose sealed containers, such as ampoules and vials, and can be stored in a freeze-dried (lyophilized) condition requiring only the addition of the sterile liquid excipient, for example, water, for injections, immediately prior to use. Extemporaneous injection solutions and suspensions in some aspects are prepared from sterile powders, granules, and tablets of the kind previously described.

Injectable formulations are in accordance with the present disclosure. The requirements for effective pharmaceutical carriers for injectable compositions are well-known to those of ordinary skill in the art (see, e.g., *Pharmaceutics and Pharmacy Practice*, J. B. Lippincott Company, Philadelphia, Pa., Banker and Chalmers, eds., pages 238-250 (1982), and *ASHP Handbook on Injectable Drugs*, Toissel, 4th ed., pages 622-630 (1986)).

Dosages

The active agents of the disclosure are believed to be useful in methods of inhibiting a PD-1 signaling, while providing IL-21 signaling, as described herein, and are thus believed to be useful in methods of treating or preventing one or more diseases, e.g., cancer. For purposes of the disclosure, the amount or dose of the active agent administered should be sufficient to effect, e.g., a therapeutic or prophylactic response, in the subject or animal over a reasonable time frame. For example, the dose of the active agent of the present disclosure should be sufficient to treat cancer as described herein in a period of from about 1 to 4 minutes, 1 to 4 hours or 1 to 4 weeks or longer, e.g., 5 to 20 or more weeks, from the time of administration. In certain embodiments, the time period could be even longer. The dose will be determined by the efficacy of the particular active agent and the condition of the animal (e.g., human), as well as the body weight of the animal (e.g., human) to be treated.

Many assays for determining an administered dose are known in the art. For purposes herein, an assay, which comprises comparing the extent to which cancer is treated upon administration of a given dose of the active agent of the present disclosure to a mammal among a set of mammals, each set of which is given a different dose of the active agent, could be used to determine a starting dose to be administered to a mammal. The extent to which cancer is treated upon administration of a certain dose can be represented by, for example, the cytotoxicity of the active agent or the extent of tumor regression achieved with the active agent in a mouse xenograft model. Methods of measuring cytotoxicity of the fusion proteins and methods of assaying tumor regression are known in the art.

The dose of the active agent of the present disclosure also will be determined by the existence, nature and extent of any adverse side effects that might accompany the administration of a particular active agent of the present disclosure. Typically, the attending physician will decide the dosage of the active agent of the present disclosure with which to treat each individual patient, taking into consideration a variety of factors, such as age, body weight, general health, diet, sex, active agent of the present disclosure to be administered, route of administration, and the severity of the condition being treated. By way of example and not intending to limit the present disclosure, the dose of the active agent of the present disclosure can be about 0.0001 to about 1 g/kg body weight of the subject being treated/day, from about 0.0001 to about 0.001 g/kg body weight/day, or about 0.01 mg to about 1 g/kg body weight/day.

Controlled Release Formulations

In some embodiments, the active agents described herein can be modified into a depot form, such that the manner in which the active agent of the present disclosure is released into the body to which it is administered is controlled with respect to time and location within the body (see, for example, U.S. Pat. No. 4,450,150). Depot forms of active agents of the present disclosure can be, for example, an implantable composition comprising the active agents and a porous or non-porous material, such as a polymer, wherein the active agent is encapsulated by or diffused throughout the material and/or degradation of the non-porous material. The depot is then implanted into the desired location within the body of the subject and the active agent is released from the implant at a predetermined rate.

The pharmaceutical composition comprising the active agent in certain aspects is modified to have any type of in vivo release profile. In some aspects, the pharmaceutical composition is an immediate release, controlled release, sustained release, extended release, delayed release, or bi-phasic release formulation. Methods of formulating peptides for controlled release are known in the art. See, for example, Qian et al., *J Pharm* 374: 46-52 (2009) and International Patent Application Publication Nos. WO 2008/130158, WO2004/033036; WO2000/032218; and WO 1999/040942.

The instant compositions can further comprise, for example, micelles or liposomes, or some other encapsulated form, or can be administered in an extended release form to provide a prolonged storage and/or delivery effect.

Combinations

In some embodiments, the fusion proteins or antigen-binding proteins (e.g., anti-PD-1 antibody, antigen binding antibody fragment thereof, or anti-PD-1 antibody protein product) described herein are administered alone, and in alternative embodiments, are administered in combination with another therapeutic agent, e.g., another active agent of the invention of different type (e.g., structure). In some aspects, the other therapeutic aims to treat or prevent cancer. In some embodiments, the other therapeutic is a chemotherapeutic agent. In some embodiments, the other therapeutic is an agent used in radiation therapy for the treatment of cancer. Accordingly, in some aspects, the fusion proteins or antigen-binding proteins (e.g., anti-PD-1 antibody, antigen binding antibody fragment thereof, or anti-PD-1 antibody protein product) described herein are administered in combination with one or more of platinum coordination compounds, topoisomerase inhibitors, antibiotics, antimitotic alkaloids and difluoronucleosides. In exemplary aspects, an IL-21 fusion protein described herein (e.g., an anti-PD-1 antibody fused to an IL-21 mutein) is combined with an antigen-binding protein (e.g., anti-PD-1 antibody, antigen binding antibody fragment thereof, or anti-PD-1 antibody protein product).

In specific embodiments, any of antibodies 20A2, 20C1, 22D4, 20C1.006, 20C1.009, 20A2.003, 22D4.006, 22D4.017 are administered in combination with an IL-21 fusion protein described herein including, for example: a fusion protein comprising a homodimer or monomer selected from:

a homodimer comprising two antibody light chains (each comprising the amino acid sequence of SEQ ID NO: 391) and two antibody heavy chains (each of which is fused to an IL-21 mutein, and each heavy chain-IL-21 mutein fusion comprises the amino acid sequence of SEQ ID NO: 496);

a homodimer comprising two antibody light chains (each comprising the amino acid sequence of SEQ ID NO: 391) and two antibody heavy chains (each of which is fused to an IL-21 mutein, and the fused heavy chain-IL-21 mutein comprises the amino acid sequence of SEQ ID NO: 497);

a homodimer comprising two antibody light chains (each comprising the amino acid sequence of SEQ ID NO: 391) and two antibody heavy chains (each of which is fused to an IL-21 mutein, and each heavy chain-IL-21 mutein fusion comprises the amino acid sequence of SEQ ID NO: 498);

a homodimer comprising two antibody light chains (each comprising the amino acid sequence of SEQ ID NO: 391) and two antibody heavy chains (each of which is fused to an IL-21 mutein, and each heavy chain-IL-21 mutein fusion comprises the amino acid sequence of SEQ ID NO: 499);

a homodimer comprising two antibody light chains (each comprising the amino acid sequence of SEQ ID NO: 391) and two antibody heavy chains (each of which is fused to an IL-21 mutein, and each heavy chain-IL-21 mutein fusion comprises the amino acid sequence of SEQ ID NO: 500);

a monomer comprising two antibody light chains (each comprising the amino acid sequence of SEQ ID NO: 391) and two different antibody heavy chains (one of which is fused to an IL-21 mutein and comprises the amino acid sequence of SEQ ID NO: 501 and one of which is not fused to an IL-21 mutein and comprises the amino acid sequence of SEQ ID NO: 555);

a monomer comprising two antibody light chains (each comprising the amino acid sequence of SEQ ID NO: 391) and two different antibody heavy chains (one of which is fused to an IL-21 mutein and comprises the amino acid sequence of SEQ ID NO: 502 and one of which is not fused to an IL-21 mutein and comprises the amino acid sequence of SEQ ID NO: 556);

a monomer comprising two antibody light chains (each comprising the amino acid sequence of SEQ ID NO: 391) and two different antibody heavy chains (one of which is fused to an IL-21 mutein and comprises the amino acid sequence of SEQ ID NO: 503 and one of which is not fused to an IL-21 mutein and comprises the amino acid sequence of SEQ ID NO: 557);

a monomer comprising two antibody light chains (each comprising the amino acid sequence of SEQ ID NO: 391) and two different antibody heavy chains (one of which is fused to an IL-21 mutein and comprises the amino acid sequence of SEQ ID NO: 504 and one of which is not fused to an IL-21 mutein and comprises the amino acid sequence of SEQ ID NO: 555);

a monomer comprising two antibody light chains (each comprising the amino acid sequence of SEQ ID NO: 391) and two different antibody heavy chains (one of which is fused to an IL-21 mutein and comprises the amino acid sequence of SEQ ID NO: 505 and one of which is not fused to an IL-21 mutein and comprises the amino acid sequence of SEQ ID NO: 556);

a monomer comprising two antibody light chains (each comprising the amino acid sequence of SEQ ID NO: 391) and two different antibody heavy chains (one of which is fused to an IL-21 mutein and comprises the amino acid sequence of SEQ ID NO: 506 and one of which is not fused to an IL-21 mutein and comprises the amino acid sequence of SEQ ID NO: 557);

a homodimer comprising two antibody light chains (each comprising the amino acid sequence of SEQ ID NO: 371) and two antibody heavy chains (each of which is fused to an IL-21 mutein, and each heavy chain-IL-21 mutein fusion comprises the amino acid sequence of SEQ ID NO: 507);

a homodimer comprising two antibody light chains (each comprising the amino acid sequence of SEQ ID NO: 371) and two antibody heavy chains (each of which is fused to an IL-21 mutein, and each heavy chain-IL-21 mutein fusion comprises the amino acid sequence of SEQ ID NO: 508);

a homodimer comprising two antibody light chains (each comprising the amino acid sequence of SEQ ID NO: 371) and two antibody heavy chains (each of which is fused to an IL-21 mutein, and each heavy chain-IL-21 mutein fusion comprises the amino acid sequence of SEQ ID NO: 509);

a homodimer comprising two antibody light chains (each comprising the amino acid sequence of SEQ ID NO: 371) and two antibody heavy chains (each of which is fused to an IL-21 mutein, and each heavy chain-IL-21 mutein fusion comprises the amino acid sequence of SEQ ID NO: 510);

a homodimer comprising two antibody light chains (each comprising the amino acid sequence of SEQ ID NO: 371) and two antibody heavy chains (each of which is fused to an IL-21 mutein, and each heavy chain-IL-21 mutein fusion comprises the amino acid sequence of SEQ ID NO: 511);

a homodimer comprising two antibody light chains (each comprising the amino acid sequence of SEQ ID NO: 371) and two antibody heavy chains (each of which is fused to an IL-21 mutein, and each heavy chain-IL-21 mutein fusion comprises the amino acid sequence of SEQ ID NO: 512);

a monomer comprising two antibody light chains (each comprising the amino acid sequence of SEQ ID NO: 371) and two different antibody heavy chains (one of which is fused to an IL-21 mutein and comprises the amino acid sequence of SEQ ID NO: 513 and one of which is not fused to an IL-21 mutein and comprises the amino acid sequence of SEQ ID NO: 558);

a monomer comprising two antibody light chains (each comprising the amino acid sequence of SEQ ID NO: 371) and two different antibody heavy chains (one of which is fused to an IL-21 mutein and comprises the amino acid sequence of SEQ ID NO: 514 and one of which is not fused to an IL-21 mutein and comprises the amino acid sequence of SEQ ID NO: 559);

a monomer comprising two antibody light chains (each comprising the amino acid sequence of SEQ ID NO: 371) and two different antibody heavy chains (one of which is fused to an IL-21 mutein and comprises the amino acid sequence of SEQ ID NO: 515 and one of which is not fused to an IL-21 mutein and comprises the amino acid sequence of SEQ ID NO: 560);

a monomer comprising two antibody light chains (each comprising the amino acid sequence of SEQ ID NO: 371) and two different antibody heavy chains (one of which is fused to an IL-21 mutein and comprises the amino acid sequence of SEQ ID NO: 516 and one of which is not fused to an IL-21 mutein and comprises the amino acid sequence of SEQ ID NO: 558);

a monomer comprising two antibody light chains (each comprising the amino acid sequence of SEQ ID NO: 371) and two different antibody heavy chains (one of which is fused to an IL-21 mutein and comprises the amino acid sequence of SEQ ID NO: 517 and one of which is not fused to an IL-21 mutein and comprises the amino acid sequence of SEQ ID NO: 559); or a monomer comprising two antibody light chains (each comprising the amino acid sequence of SEQ ID NO: 371)

and two different antibody heavy chains (one of which is fused to an IL-21 mutein and comprises the amino acid sequence of SEQ ID NO: 518 and one of which is not fused to an IL-21 mutein and comprises the amino acid sequence of SEQ ID NO: 560).

In some embodiments, the fusion proteins or antigen-binding proteins (e.g., anti-PD-1 antibody, antigen binding antibody fragment thereof, or anti-PD-1 antibody protein product) described herein are administered in combination with an engineered immune cell. Engineered immune cells have been shown to possess desired qualities in therapeutic treatments, particularly in oncology. Two main types of engineered immune cells are those that contain chimeric antigen receptors (termed "CARs" or "CAR-Ts") and T-cell receptors ("TCRs"). These engineered cells are engineered to endow them with antigen specificity while retaining or enhancing their ability to recognize and kill a target cell. Chimeric antigen receptors may comprise, for example, (i) an antigen-specific component ("antigen binding molecule"), (ii) one or more costimulatory domains, and (iii) one or more activating domains. Each domain may be heterogeneous, that is, comprised of sequences derived from different protein chains. Chimeric antigen receptor-expressing immune cells (such as T cells) may be used in various therapies, including cancer therapies. It will be appreciated that costimulating polypeptides as defined herein may be used to enhance the activation of CAR-expressing cells against target antigens, and therefore increase the potency of adoptive immunotherapy. T cells can be engineered to possess specificity to one or more desired targets. For example, T cells can be transduced with DNA or other genetic material encoding an antigen binding molecule, such as one or more single chain variable fragment ("scFv") of an antibody, in conjunction with one or more signaling molecules, and/or one or more activating domains, such as CD3 zeta.

In some embodiments, the engineered immune cells (such as CARs or TCRs), have specificity to DLL3. Delta-like 3 (DLL3) is a member of the Delta/Serrate/Lag-2 family of ligands for the Notch receptor and is thought to play a role in Notch signaling. DLL3 is an inhibitory ligand of the Notch signaling pathway normally expressed exclusively on intracellular membranes (Geffers et al. (2007) J Cell Biol; 178:465-76), and as described in U.S. Patent Application No. 62/655,725, which is hereby incorporated by reference in its entirety. Chimeric antigen receptors of the invention typically comprise: (i) a DLL3 specific antigen binding molecule, (ii) one or more costimulatory domain, and (iii) one or more activating domain. It will be appreciated that each domain may be heterogeneous, thus comprised of sequences derived from different protein chains.

In some embodiments, the chimeric antigen receptor comprises an antigen binding molecule that specifically binds to DLL3, wherein the antigen binding molecule comprises at least one of: (a) a variable heavy chain CDR1 comprising an amino acid sequence differing from that of SYYWT (SEQ ID NO:42) or GYYMH (SEQ ID NO:730) by not more than 3, 2, 1, or 0 amino acid residues; (b) a variable heavy chain CDR2 comprising an amino acid sequence differing from that of YIYYSGTTNYNPSLKS (SEQ ID NO:731) or WIDPNSGDTNYAQKFQG (SEQ ID NO:732) or WINPNSGDTSYAQRFLG (SEQ ID NO:733) by not more than 3, 2, 1, or 0 amino acid residues; (c) a variable heavy chain CDR3 comprising an amino acid sequence differing from that of IAVRGFFFDY (SEQ ID NO:734) or DPNRRSWYYGMDV (SEQ ID NO:735) or EDDSSWYGSFDY (SEQ ID NO:736) by not more than 3, 2, 1, or 0 amino acid residues; (d) a variable light chain CDR1 comprising an amino acid sequence differing from that of RASQSVSSSYLA (SEQ ID NO:737) or QASQDIRNYLN (SEQ ID NO:738) or RASQGIRNYLG (SEQ ID NO:739) by not more than 3, 2, 1, or 0 amino acid residues; (e) a variable light chain CDR2 comprising an amino acid sequence differing from that of GASTRAT (SEQ ID NO:740) or DASNLET (SEQ ID NO:741) or AASSLQS (SEQ ID NO:742) by not more than 3, 2, 1, or 0 amino acid residues; (f) a variable light chain CDR3 comprising an amino acid sequence differing from that of QQYGTSPLT (SEQ ID NO:743) or QHYDNLPLTF (SEQ ID NO:744) or LQHDSDLRTF (SEQ ID NO:745) by not more than 3, 2, 1, or 0 amino acid residues.

In some embodiments, the chimeric antigen receptor comprises an antigen binding molecule that specifically binds to DLL3, wherein the antigen binding molecule comprises the amino acid sequence of the construct of one of clones 1H2.1, 8D2, and 6B2, shown in Table H:

TABLE H

| Construct Name | SEQ ID NO: |
| --- | --- |
| 1H2.1 4-1BB AA | 746 |
| 1H2.1 CD28T AA | 747 |
| 8D2 4-1BB AA | 748 |
| 8D2 CD28T AA | 749 |
| 6B2 CD28T AA | 750 |
| 6B2 4-1BB AA | 751 |

In some embodiments, the engineered immune cells (such as CARs or TCRs), have specificity to FLT3. Fms-like tyrosine kinase 3 (FLT3) also known as fetal liver kinase 2 (FLK-2), human stem cell kinase 1 (SCK-1) or Cluster of Differentiation antigen (CD135) is a hematopoietic receptor tyrosine kinase that was cloned by two independent groups in the 1990s. The FLT3 gene, located on chromosome 13q12 in humans encodes a Class III receptor tyrosine kinase protein that shares homology with other Class III family members including stem cell factor receptor (c-KIT), macrophage colony-stimulating factor receptor (FMS) and platelet-derived growth factor receptor (PDGFR), and is further described in WO2017173410, which is hereby incorporated by reference in its entirey. Chimeric antigen receptors of the invention typically comprise: (i) a FLT3 specific antigen binding molecule, (ii) one or more costimulatory domain, and (iii) one or more activating domain. It will be appreciated that each domain may be heterogeneous, thus comprised of sequences derived from different protein chains.

In some embodiments, the invention relates to a chimeric antigen receptor comprising an antigen binding molecule that specifically binds to FLT3, wherein the antigen binding molecule comprises at least one of: (a) a variable heavy chain CDR1 comprising an amino acid sequence differing from that of the amino acid sequence NARMGVS (SEQ ID NO: 752) by not more than 3, 2, 1, or 0 amino acid residues; (b) a variable heavy chain CDR2 comprising an amino acid sequence differing from that of the amino acid sequence HIFSNAEKSYRTSLKS (SEQ ID NO: 753) or the amino acid sequence HIFSNDEKTYSTSLKS (SEQ ID NO:754) by not more than 3, 2, 1, or 0 amino acid residues; (c) a variable heavy chain CDR3 comprising an amino acid sequence differing from that of the amino acid sequence IPGYGGNGDYHYYGMDV (SEQ ID NO: 755) or the amino acid sequence IPYYGSGSHNYGMDV (SEQ ID NO:756) by not more than 3, 2, 1, or 0 amino acid residues; (d) a variable light chain CDR1 comprising an amino acid sequence differing from that of the amino acid sequence RASQGIRNDLG (SEQ ID NO: 757) or the amino acid sequence RASQDIRNDFG (SEQ ID NO: 758) by not more than 3, 2, 1, or 0 amino acid residues; (e) a variable light chain CDR2 comprising an amino acid sequence differing from that of the amino acid sequence ASSTLQS (SEQ ID NO: 759) or the amino acid sequence AASTLQS (SEQ ID NO: 760) by not more than 3, 2, 1, or 0 amino acid residues; (f) a variable light chain CDR3 comprising an amino acid sequence differing from that of the amino acid sequence LQHNNFPWT (SEQ ID NO: 761) or the amino acid sequence LQYNTYPWT (SEQ ID NO: 762) by not more than 3, 2, 1, or 0 amino acid residues.

In some embodiments, the chimeric antigen receptor comprises an antigen binding molecule that specifically binds to FLT3, wherein the antigen binding molecule comprises the amino acid sequence of the construct of one of clones 10E3, 8B5, 4E9, and 11F11, shown in Table I:

TABLE I

| Construct Name | SEQ ID NO: |
|---|---|
| 10E3 CD28 AA | 763 |
| 10E3 CD28T AA | 764 |
| 10E3 CD8 AA | 765 |
| 8B5 CD28 AA | 766 |
| 8B5 CD28T AA | 767 |
| 8B5 CD8 AA | 768 |
| 4E9 CD28 AA | 769 |
| 4E9 CD28T AA | 770 |
| 4E9 CD8 AA | 771 |
| 11F11 CD28 AA | 772 |
| 11F11 CD28T AA | 773 |
| 11F11 CD8 AA | 774 |

The invention further relates to polynucleotides encoding the chimeric antigen receptors, and vectors comprising the polynucleotides. The vector can be, for example, a retroviral vector, a DNA vector, a plasmid, a RNA vector, an adenoviral vector, an adenovirus associated vector, a lentiviral vector, or any combination thereof. The invention further relates to immune cells comprising the vectors.

In some embodiments, the lentiviral vector is a pGAR vector, such as that shown in the publication WO2017173410, which is hereby incorporated by reference in its entirety.

Exemplary immune cells include, but are not limited to T cells, tumor infiltrating lymphocytes (TILs), NK cells, TCR-expressing cells, dendritic cells, or NK-T cells. The T cells can be autologous, allogeneic, or heterologous.

In specific embodiments, any of antibodies 20A2, 20C1, 22D4, 20C1.006, 20C1.009, 20A2.003, 22D4.006, and 22D4.017 are administered in combination with an engineered immune cell comprising a chimeric antigen receptor construct as shown above. In other embodiments, any of the IL-21 fusion proteins described herein are administered in combination with an engineered immune cell comprising a chimeric antigen receptor construct as shown above. Targeting DLL3, such combinations can be used to treat a variety of tumor types including, but not limited to, adrenal, liver, kidney, bladder, breast, gastric, ovarian, cervical, uterine, esophageal, colorectal, prostate (e.g., prostate adenocarcinoma), pancreatic, lung (both small cell and non-small cell), thyroid, carcinomas, sarcomas, glioblastomas, head and neck tumors, large cell neuroendocrine carcinoma (LCNEC), medullary thyroid cancer, glioblastoma, neuroendocrine prostate cancer, (NEPC), high-grade gastroenteropancreatic cancer (GEP) and malignant melanoma. In a particular embodiment, the tumor type is small cell lung cancer. Targeting FLT3, such combinations can be used to treat a variety of tumor types including, but not limited to, acute myeloid leukemia (AML), chronic myelogenous leukemia (CML), chronic myelomonocytic leukemia (CMML), juvenile myelomonocytic leukemia, atypical chronic myeloid leukemia, acute promyelocytic leukemia (APL), acute monoblastic leukemia, acute erythroid leukemia, acute megakaryoblastic leukemia, myelodysplastic syndrome (MDS), myeloproliferative disorder, myeloid neoplasm, myeloid sarcoma), or combinations thereof. Additional diseases include inflammatory and/or autoimmune diseases such as rheumatoid arthritis, psoriasis, allergies, asthma, Crohn's disease, IBD, IBS, fibromyalga, mastocytosis, and Celiac disease. In a particular embodiment, the tumor type is AML.

In some embodiments, the fusion proteins or antigen-binding proteins (e.g., anti-PD-1 antibody, antigen binding antibody fragment thereof, or anti-PD-1 antibody protein product) described herein are administered in combination with an oncolytic virus. Oncolytic viruses have demonstrated anti-cancer activity in a variety of tumor types. Oncolytic immunotherapy is a treatment modality which uses replication competent oncolytic viruses that selectively infect and damage cancerous tissues without causing harm to normal tissues. Ongoing studies are using a variety of engineered viruses not limited to herpes simplex virus (HSV), vaccinia, and reovirus.

In exemplary aspects, the oncolytic virus is derived from a herpes simplex virus 1 (HSV-1) or herpes simplex 2 (HSV-2) strain, or from a derivative thereof, preferably HSV-1. Derivatives include inter-type recombinants containing DNA from HSV-1 and HSV-2 strains. Such inter-type recombinants are described in the art, for example in Thompson et al., (1998) Virus Genes 1(3); 275286, and Meignier et al., (1998) J. Infect. Dis. 159; 602614.

Herpes simplex virus strains may be derived from clinical isolates. Such strains are isolated from infected individuals, such as those with recurrent cold sores. Clinical isolates may be screened for a desired ability or characteristic such as enhanced replication in tumor and/or other cells in vitro and/or in vivo in comparison to standard laboratory strains, as described in U.S. Pat. Nos. 7,063,835 and 7,223,593, each of which are incorporated by reference in their entirety. In one embodiment the herpes simplex virus is a clinical isolate from a recurrent cold sore. Additional herpes simplex virus 1 virus strains include, but are not limited to, strain JS1, strain 17+, strain F, strain KOS, and strain Patton.

Examples of HSV genes that can be modified include virulence genes encoding proteins such as ICP34.5 (γ34.5). ICP34.5 acts as a virulence factor during HSV infection, limits replication in non-dividing cells and renders the virus non-pathogenic. Another HSV gene that can be modified is the gene encoding ICP47. ICP47 down-regulates major histocompatibility complex (MHC) class I expression on the surface of infected host cells and MHC Class I binding to transporter associated with antigen presentation (TAP). Such actions block antigenic peptide transport in the endoplasmic reticulum and loading of MHC class I molecules. Another HSV gene that can be modified is ICP6, the large subunit of ribonucleotide reductase, involved in nucleotide metabolism and viral DNA synthesis in non-dividing cells but not in dividing cells. Thymidine kinase, responsible for phosphorylating acyclovir to acyclovir-monophosphate, virion trans-activator protein vmw65, glycoprotein H, vhs, ICP43, and immediate early genes encoding ICP4, ICP27, ICP22 and/or ICPO, may be modified as well (in addition or alternative to the genes referenced above).

Herpes virus strains and how to make such strains are also described in U.S. Pat. Nos. 5,824,318; 6,764,675; 6,770,274; 7,063,835; 7,223,593; 7,749,745; 7,744,899; 8,273,568; 8,420,071; and 8,470,577; WIPO Publication Numbers WO199600007; WO199639841; WO199907394; WO200054795; WO2006002394; and WO201306795; Chinese Patent Numbers CN128303, CN10230334 and CN 10230335; Varghese and Rabkin, (2002) Cancer Gene Therapy 9:967-97, and Cassady and Ness Parker, (2010) The Open Virology Journal 4:103-108, which are incorporated by reference in their entirety.

In one embodiment, the oncolytic virus is talimogene laherparepvec (IMLYGIC®), derived from a clinical strain (HSV-1 strain JS1) deposited at the European collection of cell cultures (ECAAC) under accession number 01010209. In talimogene laherparepvec, the HSV-1 viral genes encoding ICP34.5 and ICP47 have been functionally deleted. Functional deletion of ICP47 leads to earlier expression of US11, a gene that promotes virus growth in tumor cells without decreasing tumor selectivity. The coding sequence for human GM-CSF, has been inserted into the viral genome at the former ICP34.5 sites (see Liu et al., Gene Ther 10: 292-303, 2003).

Other examples of oncolytic viruses include RP1 (HSV-1/ICP34.5-/ICP47-/GM-CSF/GALV-GP R(−); RP-2 (HSV-1/ICP34.5-/ICP47-/GM-CSF/GALV-GP R(−)/anti-CTLA-4 binder; and RP3 (HSV-1/ICP34.5-/ICP47-/GM-CSF/GALV-GP R(−)/anti-CTLA-4 binder/co-stimulatory ligands (e.g., CD40L, 4-1BBL, GITRL, OX40L, ICOSL)). In such oncolytic viruses, GALV (gibbon ape leukemia virus) has been modified with a specific deletion of the R-peptide, resulting in GALV-GP R(−). Such oncolytic virsues are discussed in WO2017118864, WO2017118865, WO2017118866, WO2017118867, and WO2018127713A1, each of which is incorporated by reference in its entirety.

Additional examples of oncolytic viruses include NSC-733972, HF-10, BV-2711, JX-594, Myb34.5, AE-618, Brainwel™, and Heapwel™, Cavatak® (coxsackievirus, CVA21), HF-10, Seprehvir®, Reolysin®, enadenotucirev, ONCR-177, and those described in U.S. Pat. No. 10,105,404, WO2018006005, WO2018026872A1, and WO2017181420, each of which is incorporated by reference in its entirety.

In specific embodiments, any of antibodies 20A2, 20C1, 22D4, 20C1.006, 20C1.009, 20A2.003, 22D4.006, and 22D4.017 are administered in combination with an onloytic virus such as talimogene laherparepvec. In other embodiments, any of the IL-21 fusion proteins described herein are administered in combination with an onloytic virus such as talimogene laherparepvec. Such combinations can be used to treat a variety of tumor types including, but not limited to, melanoma, head and neck cancer, breast cancer (e.g., triple negative breast cancer), colorectal cancer, hepatocellular carcinoma, gastroesophageal cancer (e.g., adenocarcinoma or squamous cell carcinoma), non-small cell lung cancer, and clear cell renal cell carcinoma. In a particular embodiment, the tumor type is melanoma.

Kits

The present disclosure additionally provides kits comprising an IL-21 mutein, PD-1 antigen-binding protein (e.g., an anti-PD-1 antibodies), a conjugate, fusion protein, nucleic acid, vector, or host cell of the present disclosure, or a combination thereof. The kit in exemplary aspects comprises at least one IL-21 mutein, PD-1 antigen-binding protein (e.g., an anti-PD-1 antibodies), a conjugate, fusion protein, nucleic acid, vector, or host cell of the present disclosure, or a combination thereof, in a container. In exemplary aspects, the at least one IL-21 mutein, PD-1 antigen-binding protein (e.g., an anti-PD-1 antibodies), a conjugate, fusion protein, nucleic acid, vector, or host cell of the present disclosure, is provided in the kit as a unit dose. For purposes herein "unit dose" refers to a discrete amount dispersed in a suitable carrier. In exemplary aspects, the unit dose is the amount sufficient to provide a subject with a desired effect, e.g., treatment of cancer. In exemplary aspects, the kit comprises several unit doses, e.g., a week or month supply of unit doses, optionally, each of which is individually packaged or otherwise separated from other unit doses. In some embodiments, the components of the kit/unit dose are packaged with instructions for administration to a patient. In some embodiments, the kit comprises one or more devices for administration to a patient, e.g., a needle and syringe, and the like. In some aspects, the at least one IL-21 mutein, PD-1 antigen-binding protein (e.g., an anti-PD-1 antibodies), a conjugate, fusion protein, nucleic acid, vector, or host cell of the present disclosure, or a combination thereof, is/are pre-packaged in a ready to use form, e.g., a syringe, an intravenous bag, etc. In exemplary aspects, the ready to use form is for a single use. In exemplary aspects, the kit comprises multiple single use, ready to use forms of the at least one IL-21 mutein, PD-1 antigen-binding protein (e.g., an anti-PD-1 antibodies), a conjugate, fusion protein, nucleic acid, vector, or host cell of the present disclosure. In some aspects, the kit further comprises other therapeutic or diagnostic agents or pharmaceutically acceptable carriers (e.g., solvents, buffers, diluents, etc.), including any of those described herein.

Methods of Manufacture

The IL-21 muteins of the present disclosure may be obtained by methods known in the art. Suitable methods of de novo synthesizing polypeptides are described in, for example, Chan et al., Fmoc Solid Phase Peptide Synthesis, Oxford University Press, Oxford, United Kingdom, 2005; Peptide and Protein Drug Analysis, ed. Reid, R., Marcel Dekker, Inc., 2000; Epitope Mapping, ed. Westwood et al., Oxford University Press, Oxford, United Kingdom, 2000; and U.S. Pat. No. 5,449,752. Additional exemplary methods of making the peptides of the invention are set forth herein.

In some embodiments, the IL-21 muteins described herein are commercially synthesized by companies, such as Synpep (Dublin, Calif.), Peptide Technologies Corp. (Gaithersburg, Md.), Multiple Peptide Systems (San Diego, Calif.), Peptide 2.0 Inc. (Chantilly, Va.), and American Peptide Co. (Sunnyvale, Calif.). In this respect, the IL-21 muteins can be synthetic, recombinant, isolated, and/or purified.

Also, in some aspects, the IL-21 muteins are recombinantly produced using a nucleic acid encoding the amino acid sequence of the peptide using standard recombinant methods. See, for instance, Sambrook et al., Molecular Cloning: A Laboratory Manual. 3rd ed., Cold Spring Harbor Press, Cold Spring Harbor, N.Y. 2001; and Ausubel et al., Current Protocols in Molecular Biology, Greene Publishing Associates and John Wiley & Sons, N Y, 1994.

Methods of making an IL-21 mutein are provided herein. The method, in exemplary embodiments, comprises culturing a host cell of the present disclosure to express the IL-21 mutein and harvesting the expressed IL-21 mutein.

Methods of making fusion protein comprising an IL-21 mutein are also provided herein. The method, in exemplary embodiments, comprises culturing a host cell of the present disclosure to express the fusion protein and harvesting the expressed fusion protein.

In exemplary embodiments, the method comprises culturing a host cell comprising a nucleic acid encoding the IL-21 mutein or fusion protein as described herein so as to express the IL-21 mutein or fusion protein. The host cell can be any of the host cells described herein. In exemplary aspects, the host cell is selected from the group consisting of: CHO cells, NSO cells, COS cells, VERO cells, and BHK cells. In exemplary aspects, the step of culturing a host cell comprises culturing the host cell in a growth medium to support the growth and expansion of the host cell. In exemplary aspects, the growth medium increases cell density, culture viability and productivity in a timely manner. In exemplary aspects, the growth medium comprises amino acids, vitamins, inorganic salts, glucose, and serum as a source of growth factors, hormones, and attachment factors. In exemplary aspects, the growth medium is a fully chemically defined media consisting of amino acids, vitamins, trace elements, inorganic salts, lipids and insulin or insulin-like growth factors. In addition to nutrients, the growth medium also helps maintain pH and osmolality. Several growth media are commercially available and are described in the art. See, e.g., Arora, "Cell Culture Media: A Review" MATER METHODS 3:175 (2013).

In exemplary aspects, the method of making an IL-21 mutein or fusion protein of the present disclosure comprises culturing the host cell in a feed medium. In exemplary aspects, the method comprises culturing in a feed medium in a fed-batch mode. Methods of recombinant protein production are known in the art. See, e.g., Li et al., "Cell culture processes for monoclonal antibody production" MAbs 2(5): 466-477 (2010).

The method making an IL-21 mutein or fusion protein can comprise one or more steps for purifying the mutein or protein from a cell culture or the supernatant thereof and preferably recovering the purified protein. In exemplary aspects, the method comprises one or more chromatography steps, e.g., affinity chromatography (e.g., protein A affinity chromatography), ion exchange chromatography, hydrophobic interaction chromatography. In exemplary aspects, the method comprises purifying the protein using a Protein A affinity chromatography resin.

In exemplary embodiments, the method further comprises steps for formulating the purified protein, etc., thereby obtaining a formulation comprising the purified protein. Such steps are described in Formulation and Process Development Strategies for Manufacturing, eds. Jameel and Hershenson, John Wiley & Sons, Inc. (Hoboken, N.J.), 2010.

Methods of Use

Methods of treatment are additionally provided by the present disclosure. The method, in exemplary embodiments, is a method of treating a subject in need thereof, comprising administering to the subject in need thereof a pharmaceutical composition of the present disclosure in an amount effective to treat the subject.

The pharmaceutical compositions of the present disclosure are useful for inhibiting PD-1 signaling and/or activating IL-21 signaling. Without being bound to a particular theory, [1] the PD-1 inhibiting activity of the compositions provided herein allow such entities to be useful in methods of enhancing T cell activity and enhancing an immune response, and, in particular, an immune response against a tumor or cancer; and/or [2] the IL-21 activating activity of the compositions provided herein allow such entities to enhance T cell survival and effector function, restrict terminal differentiation and loss of replicative potential, promote T cell longevity by shifting activated effector cells towards a more naïve T cell phenotype (e.g., by enhancing CCR7 expression), and enhance cytotoxicity against target (e.g., cancer) cell (e.g., by increasing IFNγ and granzyme B production.

Accordingly, provided herein are methods of enhancing T cell activity in a subject, enhancing T cell survival and effector function, restricting terminal differentiation and loss of replicative potential, promoting T cell longevity, and enhancing cytotoxicity against target (e.g., cancer) cells. In exemplary embodiments, the methods comprise administering to the subject the pharmaceutical composition of the present disclosure in an effective amount. In exemplary aspects, the T cell activity or immune response is directed against a cancer cell or cancer tissue or a tumor cell or tumor. In exemplary aspects, the immune response is a humoral immune response. In exemplary aspects, the immune response is an innate immune response. In exemplary aspects, the immune response which is enhanced is a T-cell mediated immune response.

As used herein, the term "enhance" and words stemming therefrom may not be a 100% or complete enhancement or increase. Rather, there are varying degrees of enhancement of which one of ordinary skill in the art recognizes as having a potential benefit or therapeutic effect. In this respect, the pharmaceutical compositions of the present disclosure may enhance, e.g., T cell activity or enhance an immune response, to any amount or level. In exemplary embodiments, the enhancement provided by the methods of the present disclosure is at least or about a 10% enhancement (e.g., at least or about a 20% enhancement, at least or about a 30% enhancement, at least or about a 40% enhancement, at least or about a 50% enhancement, at least or about a 60% enhancement, at least or about a 70% enhancement, at least or about a 80% enhancement, at least or about a 90% enhancement, at least or about a 95% enhancement, at least or about a 98% enhancement).

Methods of measuring T cell activity and immune responses are known in the art. T cell activity can be measured by, for example, a cytotoxicity assay, such as those described in Fu et al., PLoS ONE 5(7): e11867 (2010). Other T cell activity assays are described in Bercovici et al., Clin Diagn Lab Immunol. 7(6): 859-864 (2000). Methods of measuring immune responses are described in e.g., Macatangay et al., Clin Vaccine Immunol 17(9): 1452-1459 (2010), and Clay et al., Clin Cancer Res. 7(5):1127-35 (2001).

Additionally provided herein are methods of treating a subject with cancer and methods of treating a subject with a solid tumor. In exemplary embodiments, the method comprises administering to the subject the pharmaceutical composition of the present disclosure in an amount effective for treating the cancer or the solid tumor in the subject. The cancer treatable by the methods disclosed herein can be any cancer, e.g., any malignant growth or tumor caused by abnormal and uncontrolled cell division that may spread to other parts of the body through the lymphatic system or the blood stream. The cancer in some aspects is one selected from the group consisting of acute lymphocytic cancer, acute myeloid leukemia, alveolar rhabdomyosarcoma, bone cancer, brain cancer, breast cancer, cancer of the anus, anal canal, or anorectum, cancer of the eye, cancer of the intrahepatic bile duct, cancer of the joints, cancer of the neck, gallbladder, or pleura, cancer of the nose, nasal cavity, or middle ear, cancer of the oral cavity, cancer of the vulva, chronic lymphocytic leukemia, chronic myeloid cancer, colon cancer, esophageal cancer, cervical cancer, gastrointestinal carcinoid tumor, Hodgkin lymphoma, hypopharynx cancer, kidney cancer, larynx cancer, liver cancer, lung cancer, malignant mesothelioma, melanoma, multiple myeloma, nasopharynx cancer, non-Hodgkin lymphoma, ovarian cancer, pancreatic cancer, peritoneum, omentum, and mesentery cancer, pharynx cancer, prostate cancer, rectal cancer, renal cancer (e.g., renal cell carcinoma (RCC)), small intestine cancer, soft tissue cancer, stomach cancer, testicular cancer, thyroid cancer, ureter cancer, and urinary bladder cancer. In particular aspects, the cancer is selected from the group consisting of: head and neck, ovarian, cervical, bladder and oesophageal cancers, pancreatic, gastrointestinal cancer, gastric, breast, endometrial and colorectal cancers, hepatocellular carcinoma, glioblastoma, bladder, lung cancer, e.g., non-small cell lung cancer (NSCLC), bronchioloalveolar carcinoma. In particular embodiments, the tumor is non-small cell lung cancer (NSCLC), head and neck cancer, renal cancer, triple negative breast cancer, and gastric cancer. In exemplary aspects, the subject has a tumor (e.g., a solid tumor, a hematological malignancy, or a lymphoid malignancy) and the pharmaceutical composition is administered to the subject in an amount effective to treat the tumor in the subject. In other exemplary aspects, the tumor is non-small cell lung cancer (NSCLC), small cell lung cancer (SCLC), head and neck cancer, renal cancer, breast cancer, melanoma, ovarian cancer, liver cancer, pancreatic cancer, colon cancer, prostate cancer, gastric cancer, lymphoma or leukemia, and the pharmaceutical composition is administered to the subject in an amount effective to treat the tumor in the subject.

As used herein, the term "treat," as well as words related thereto, do not necessarily imply 100% or complete treatment. Rather, there are varying degrees of treatment of which one of ordinary skill in the art recognizes as having a potential benefit or therapeutic effect. In this respect, the methods of treating cancer of the present disclosure can provide any amount or any level of treatment. Furthermore, the treatment provided by the method of the present disclosure can include treatment of one or more conditions or symptoms or signs of the cancer being treated. Also, the treatment provided by the methods of the present disclosure can encompass slowing the progression of the cancer. For example, the methods can treat cancer by virtue of enhancing the T cell activity or an immune response against the cancer, reducing tumor or cancer growth, reducing metastasis of tumor cells, increasing cell death of tumor or cancer cells, and the like. In exemplary aspects, the methods treat by way of delaying the onset or recurrence of the cancer by 1 day, 2 days, 4 days, 6 days, 8 days, 10 days, 15 days, 30 days, two months, 4 months, 6 months, 1 year, 2 years, 4 years, or more. In exemplary aspects, the methods treat by way increasing the survival of the subject.

Subjects

In some embodiments of the present disclosure, the subject is a mammal, including, but not limited to, mammals of the order Rodentia, such as mice and hamsters, and mammals of the order Logomorpha, such as rabbits, mammals from the order Carnivora, including Felines (cats) and Canines (dogs), mammals from the order Artiodactyla, including Bovines (cows) and Swines (pigs) or of the order Perssodactyla, including Equines (horses). In some aspects, the mammals are of the order Primates, Ceboids, or Simoids (monkeys) or of the order Anthropoids (humans and apes). In some aspects, the mammal is a human.

Exemplary Embodiments

In exemplary embodiments, the present disclosure provides an IL-21 mutein comprising the amino acid sequence of SEQ ID NO: 2, QGQDX HMXXM XXXXX XVDXL KNXVN DLVPE FLPAP EDVET NCEWS AFSCF QKAQL KSANT GNNEX XIXXX XXXLX XXXXX TNAGR RQKHR LTCPS CDSYE KKPPK EFLXX FXXLL XXMXX QHXSS RTHGS EDS (SEQ ID NO: 2), wherein "X" represents any amino acid, and wherein the IL-21 mutein amino acid sequence differs from the amino acid sequence of human IL-21 (SEQ ID NO: 1) by at least 1 amino acid.

In exemplary aspects, the IL-21 mutein comprises an amino acid sequence which differs from the amino acid sequence of human IL-21 (SEQ ID NO: 1) by no more than 7 amino acids. In exemplary aspects, the IL-21 mutein comprises an amino acid sequence which differs from the amino acid sequence of human IL-21 (SEQ ID NO: 1) by 3, 4, 5, or 6 amino acids. In exemplary instances, the IL-21 mutein comprises an amino acid sequence which differs from the amino acid sequence of human IL-21 (SEQ ID NO: 1) by 1 or 2 amino acids. In exemplary aspects, the difference(s) between the amino acid sequence of the IL-21 mutein and the amino acid sequence of SEQ ID NO: 1 is/are within amino acids 10-15, inclusive, or amino acids 105-123, inclusive, of SEQ ID NO: 2, optionally, wherein the difference(s) occur(s) at amino acids 11, 14, 15, 109, 110, 112, 113, 116, 119, 120, and/or 123 of SEQ ID NO: 2. In exemplary aspects, the difference(s) between the amino acid sequence of the IL-21 mutein and the amino acid sequence of SEQ ID NO: 1 is/are within amino acids 5-25, inclusive, or amino acids 65-80, inclusive, of SEQ ID NO: 2, optionally, wherein the difference(s) occur(s) at amino acids 5, 8, 9, 12, 13, 16, 19, 23, 65, 66, 69, 70, 72, 73, 75, 76, 77, 78, 79, and/or 80 of SEQ ID NO: 2.

In some aspects, the IL-21 mutein comprises an amino acid sequence with one amino acid substitution relative to the amino acid sequence of human IL-21 (SEQ ID NO: 1). In some instances, the amino acid substitution occurs at position 5, 8, 9, 11, 12, 13, 14, 15, 16, 19, 23, 65, 66, 68, 69, 70, 71, 72, 73, 75, 76, 77, 78, 79, 80, 109, 110, 112, 113, 116, 117, 119, 120, or 123 of SEQ ID NO: 1. In exemplary aspects, the amino acid substitution occurs at position 5, 8, 9, 11, 12, 13, 14, 15, 16, 19, 23, 65, 66, 68, 69, 70, 72, 73, 75, 76, 77, 78, 79, 80, 109, 110, 112, 113, 116, 117, 119, 120, or 123 of SEQ ID NO: 1. In exemplary instances, the IL-21 mutein comprises an amino acid substitution:

a. at position 5, 8, 9, 12, 14, 15, 65, 66, 69, 70, 72, 73, 75, 76, 77, 80, 116, or 119 of SEQ ID NO: 1, wherein the substitute amino acid is an aliphatic amino acid
b. at position 5, 8, 9, 11, 12, 13, 14, 15, 16, 19, 23, 65, 66, 69, 70, 72, 73, 75, 76, 77, 78, 79, 110, 112, 116, 117, 119, 120, or 123 of SEQ ID NO: 1, wherein the substitute amino acid is an acidic amino acid;
c. at position 5, 9, 73, 76, 109, 113, or 116 of SEQ ID NO: 1, wherein the substitute amino acid is a basic amino acid;
d. at position 5, 8, 9, 70, or 76 of SEQ ID NO: 1, wherein the substitute amino acid is an aromatic amino acid;
e. at position 5, 8, 9, 12, 15, 73, 76, 116, or 119 of SEQ ID NO: 1, wherein the substitute amino acid is an amino acid comprising a side chain amide;

f. at position 5, 8, 9, 11, 12, 14, 15, 73, 76, 116, or 119 of SEQ ID NO: 1, wherein the substitute amino acid is a non-aromatic amino acid comprising a side chain hydroxyl;

g. at position 65, 66, 69, 70, 72, 73, 75, 76, 77, or 80 of SEQ ID NO: 1, wherein the substitute amino acid is an imino acid;

h. at position 5, 9, 15, 76, 116, or 119 of SEQ ID NO: 1, wherein the substitute amino acid is an amino acid comprising a sulfur-containing side chain; or i. or a combination thereof.

In exemplary aspects, the substitute amino acid is a naturally occurring amino acid. In some instances, the IL-21 mutein comprises an amino acid substitution with an amino acid at the position according to TABLE A. Table A is shown below.

TABLE A

| Amino Acid position of SEQ ID NO: 1 | Amino Acid (in single letter code) |
|---|---|
| 5 | A, D, E, G, H, I, K, L, M, N, Q, S, T, V, or Y |
| 8 | A, D, E, N, S, T, V, or Y |
| 9 | A, D, E, G, H, I, K, L, M, N, Q, S, T, V, or Y |
| 11 | D or S |
| 12 | A, D, E, N, S, T, or V |
| 13 | D |
| 14 | A, D, or S |
| 15 | A, E, I, M, N, Q, S, T, or V |
| 16 | D or E |
| 19 | D |
| 23 | D |
| 65 | D, G, or P |
| 66 | D, G, or P |
| 68 | Q |
| 69 | D, G, or P |
| 70 | E, G, P, or Y |
| 71 | L |
| 72 | D, G, or P |
| 73 | A, D, E, G, H, I, N, P, Q, S, or V |
| 75 | D, G, or P |
| 76 | A, D, E, G, H, I, K, L, M, N, P, Q, S, T, V, or Y |
| 77 | D, G, or P |
| 78 | D |
| 79 | D |
| 80 | G, or P |
| 109 | K |
| 110 | D |
| 112 | D |
| 113 | K |
| 116 | A, D, E, I, K, L, M, N, S, T, or V |
| 117 | D |
| 119 | A, D, E, M, N, Q, S, or T |
| 120 | D |
| 123 | D |

In exemplary embodiments, the present disclosure provides an IL-21 mutein comprising an amino acid sequence of any one of SEQ ID NOs: 3-21, 23-56, 58-112, 114-208, 210-222, 224-255, and 283.

In exemplary aspects, the IL-21 mutein comprises an amino acid sequence with two amino acid substitutions relative to the amino acid sequence of human IL-21 (SEQ ID NO: 1). In exemplary aspects, the amino acid substitution occurs at two of positions 5, 8, 9, 11, 12, 13, 14, 15, 16, 19, 23, 65, 66, 68, 69, 70, 71, 72, 73, 75, 76, 77, 78, 79, 80, 109, 110, 112, 113, 116, 117, 119, 120, or 123 of SEQ ID NO: 1. In exemplary instances, the amino acid substitutions occur at two of positions 5, 9, 15, 70, 71, 72, 73, and 76 of SEQ ID NO: 1. Optionally, the amino acid substitutions occur at two of positions 5, 9, 73, and 76 or SEQ ID NO: 1. In some aspects, one of the substitutions occurs at position 76 of SEQ ID NO: 1. In exemplary instances, the substitute amino acid at position 76 of SEQ ID NO: 1 is an aliphatic amino acid or an acidic amino acid. In exemplary aspects, the IL-21 mutein comprises an amino acid substitution at position 5, 9, or 73 of SEQ ID NO: 1, and the substitute amino acid is an aliphatic amino acid or acidic amino acid. In some aspects, the IL-21 mutein comprises an amino acid substitution at position 5 of SEQ ID NO: 1, and the substitute amino acid is an amino acid with a side chain amide. In some instances, the aliphatic amino acid is alanine, the acidic amino acid is glutamic acid, or the amino acid with a side chain amide is glutamine. The present disclosure, in exemplary embodiments, provides an IL-21 mutein comprising an amino acid sequence selected from the group consisting of SEQ ID NOs: 208, 210 to 222, 224 to 248, and 255.

With regard to any of the above aspects, the IL-21 mutein may bind to the IL-21 receptor with a reduced affinity, relative to the affinity of wild-type IL-21 for the IL-21 receptor. In some aspects, the IL-21 receptor has an amino acid sequence of SEQ ID NO: 256 or 261. In some instances, the IL-21 mutein binds to a IL-21 receptor gamma chain having an amino acid sequence of SEQ ID NO: 257. In exemplary instances, the IL-21 mutein of the present disclosure binds to the human IL-21 receptor of with a Kd that is greater than or is about 0.04 nM.

Further provided are conjugates. In exemplary aspects, the conjugate comprises an IL-21 mutein of any one of the preceding paragraphs and a heterologous moiety. In exemplary instances, the IL-21 is directly attached to the heterologous moiety. In alternative instances, the IL-21 is attached to the heterologous moiety via a linker. In some aspects, the linker comprises a peptide, e.g., comprising an amino acid sequence of Gly-Gly-Gly-Gly-Ser (SEQ ID NO: 262). In exemplary aspects, the heterologous moiety is a polypeptide, optionally, wherein the polypeptide is an antigen-binding protein. In some instances, the heterologous polypeptide is an antibody or an antigen binding antibody fragment thereof. In exemplary embodiments, the antibody is an anti-PD-1 antibody. In some aspects, the IL-21 mutein is directly attached to the Fc of the antibody. In exemplary aspects, the IL-21 mutein is attached to the Fc of the antibody via a linker. The conjugate in some aspects comprises a single IL-21 mutein, wherein said single IL-21 mutein is linked to the C-terminus of one of the two antibody heavy chains. In exemplary instances, the conjugate comprises two IL-21 muteins, wherein the first IL-21 mutein is linked to the C-terminus of the first antibody heavy chain, and the second IL-21 mutein is linked to the C-terminus of the second antibody heavy chain. Optionally, the first IL-21 has the same amino acid sequence as the second IL-21 mutein. Alternatively, the first IL-21 has a different amino acid sequence than the second IL-21 mutein. In exemplary aspects, the antibody heavy chains comprise charge pair mutations (e.g., the V1, V4, V103, or V131 mutations). In exemplary aspects of the conjugate of any one of the preceding paragraphs, the IL-21 mutein comprises amino acid substitutions at two of positions 5, 9, 73, and 76 of SEQ ID NO: 1. In exemplary aspects, the conjugate comprises an IL-21 mutein comprising the amino acid sequence of SEQ ID NO: 1, except that said IL-21 mutein comprises amino acid substitutions at any two of positions 5, 9, 73, and 76 of SEQ ID NO: 1, and an anti-PD-1 antibody, wherein the IL-21 mutein is linked to the C-terminus of the anti-PD-1 antibody. In exemplary aspects, the conjugate comprises an anti-PD-1 antibody comprising (a) a heavy chain (HC)

complementarity-determining region (CDR) 1 amino acid sequence set forth in Table D or a sequence selected from the group consisting of: SEQ ID NOs: 312, 322, 332, 342, 352, 362, 372, and 382, or a variant sequence thereof which differs by only one or two amino acids or which has at least or about 70% sequence identity; (b) an HC CDR2 amino acid sequence set forth in Table D or a sequence selected from the group consisting of: SEQ ID NOs: 313, 323, 333, 343, 353, 363, 373, and 383, or a variant sequence thereof which differs by only one or two amino acids or which has at least or about 70% sequence identity; (c) an HC CDR3 amino acid sequence set forth in Table D or a sequence selected from the group consisting of: SEQ ID NOs: 314, 324, 334, 344, 354, 364, 374, and 384, or a variant sequence thereof which differs by only one or two amino acids or which has at least or about 70% sequence identity; (d) a light chain (LC) CDR1 amino acid sequence set forth in Table D or a sequence selected from the group consisting of: 315, 325, 335, 345, 355, 365, 375, and 385, or a variant sequence thereof which differs by only one or two amino acids or which has at least or about 70% sequence identity; (e) an LC CDR2 amino acid sequence set forth in Table D or a sequence selected from the group consisting of: 316, 326, 336, 346, 356, 366, 376, and 386, or a variant sequence thereof which differs by only one or two amino acids or which has at least or about 70% sequence identity; (f) an LC CDR3 amino acid sequence set forth in Table D or a sequence selected from the group consisting of: 317, 327, 337, 347, 357, 367, 377, and 387, or a variant sequence thereof which differs by only one or two amino acids or which has at least or about 70% sequence identity; or (g) a combination of any two or more of (a)-(f). In exemplary instances, the anti-PD-1 antibody comprises six CDR amino acid sequences selected from the group consisting of: (a) SEQ ID NOs: 312-317; (b) SEQ ID NOs: 322-327; (c) SEQ ID NOs: 332-337; (d) SEQ ID NOs: 342-347; (e) SEQ ID NOs: 352-357; (f) SEQ ID NOs: 362-367; (g) SEQ ID NOs: 372-377; and (h) SEQ ID NOs: 382-387. In some aspects, the anti-PD-1 antibody comprises a pair of amino acid sequences selected from the group consisting of: (a) SEQ ID NOs: 318 and 319; (b) SEQ ID NOs: 328 and 329; (c) SEQ ID NOs: 338 and 339; (d) SEQ ID NOs: 348 and 349; (e) SEQ ID NOs: 358 and 359; (f) SEQ ID NOs: 368 and 369; (g) SEQ ID NOs: 378 and 379; and (h) SEQ ID NOs: 388 and 389. In exemplary aspects, the anti-PD-1 antibody comprises a constant region comprising an amino acid sequence of any one of SEQ ID NOs: 265-267, 282, 284-311. In certain instances, the anti-PD-1 antibody comprises a pair of amino acid sequences selected from the group consisting of: (a) SEQ ID NOs: 320 and 321; (b) SEQ ID NOs: 330 and 331; (c) SEQ ID NOs: 340 and 341; (d) SEQ ID NOs: 350 and 351; (e) SEQ ID NOs: 360 and 361; (f) SEQ ID NOs: 370 and 371; (g) SEQ ID NOs: 380 and 381; and (h) SEQ ID NOs: 390 and 391.

In exemplary embodiments, the present disclosure provides a fusion polypeptide or fusion protein comprising an IL-21 mutein described herein and a heterologous polypeptide or peptide. In some aspects, the fusion polypeptide or fusion protein comprises an immunoglobulin or an antigen binding antibody fragment thereof. In exemplary embodiments, the present disclosure provides a nucleic acid comprising a nucleotide sequence encoding an IL-21 mutein described herein. In exemplary embodiments, the present disclosure provides a vector comprising the nucleic acid described herein. In exemplary embodiments, the present disclosure provides a host cell comprising the nucleic acid or the vector described herein. In exemplary embodiments, the present disclosure provides a kit comprising an IL-21 mutein, a nucleic acid, vector, host cell, conjugate, fusion protein, or a combination thereof, as described herein, and a container.

Further provided are pharmaceutical compositions comprising an IL-21 mutein, a nucleic acid, vector, host cell, conjugate, fusion protein, or a combination thereof, of the present disclosure, and a pharmaceutically acceptable carrier, excipient, or diluent.

Also provided are methods of making an IL-21 mutein comprising culturing the host cell of the present disclosure so as to express the IL-21 mutein and harvesting the expressed IL-21 mutein. A method of treating a subject in need thereof is further provided. The method comprises administering to the subject in need thereof a pharmaceutical composition of the present disclosure in an amount effective to treat the subject. In exemplary aspects, the subject has a solid tumor and the pharmaceutical composition is administered to the subject in an amount effective to treat the solid tumor in the subject. Optionally, the the solid tumor is selected from the group consisting of: head and neck, ovarian, cervical, bladder and oesophageal cancers, pancreatic, gastrointestinal cancer, gastric, breast, endometrial and colorectal cancers, hepatocellular carcinoma, glioblastoma, bladder, lung cancer, e.g., non-small cell lung cancer (NSCLC), bronchioloalveolar carcinoma.

In exemplary embodiments, the present disclosure provides a PD-1 antigen-binding protein comprising (a) a heavy chain (HC) complementarity-determining region (CDR) 1 amino acid sequence set forth in Table D or a sequence selected from the group consisting of: SEQ ID NOs: 312, 322, 332, 342, 352, 362, 372, and 382, or a variant sequence thereof which differs by only one or two amino acids or which has at least or about 70% sequence identity; (b) an HC CDR2 amino acid sequence set forth in Table D or a sequence selected from the group consisting of: SEQ ID NOs: 313, 323, 333, 343, 353, 363, 373, and 383, or a variant sequence thereof which differs by only one or two amino acids or which has at least or about 70% sequence identity; (c) an HC CDR3 amino acid sequence set forth in Table D or a sequence selected from the group consisting of: SEQ ID NOs: 314, 324, 334, 344, 354, 364, 374, and 384, or a variant sequence thereof which differs by only one or two amino acids or which has at least or about 70% sequence identity; (d) a light chain (LC) CDR1 amino acid sequence set forth in Table D or a sequence selected from the group consisting of: 315, 325, 335, 345, 355, 365, 375, and 385, or a variant sequence thereof which differs by only one or two amino acids or which has at least or about 70% sequence identity; (e) an LC CDR2 amino acid sequence set forth in Table D or a sequence selected from the group consisting of: 316, 326, 336, 346, 356, 366, 376, and 386, or a variant sequence thereof which differs by only one or two amino acids or which has at least or about 70% sequence identity; (f) an LC CDR3 amino acid sequence set forth in Table D or a sequence selected from the group consisting of: 317, 327, 337, 347, 357, 367, 377, and 387, or a variant sequence thereof which differs by only one or two amino acids or which has at least or about 70% sequence identity; or (g) a combination of any two or more of (a)-(f). In exemplary instances, the PD-1 antigen-binding protein comprises six CDR amino acid sequences selected from the group consisting of: (a) SEQ ID NOs: 312-317; (b) SEQ ID NOs: 322-327; (c) SEQ ID NOs: 332-337; (d) SEQ ID NOs: 342-347; (e) SEQ ID NOs: 352-357; (f) SEQ ID NOs: 362-367; (g) SEQ ID NOs: 372-377; and (h) SEQ ID NOs: 382-387. In certain aspects, the PD-1 antigen-binding protein comprises a pair of amino acid sequences selected from the group consisting of: (a) SEQ ID NOs: 318 and 319; (b) SEQ ID NOs: 328 and 329; (c) SEQ ID NOs: 338 and 339; (d) SEQ ID NOs: 348 and 349; (e) SEQ ID NOs: 358 and 359; (f) SEQ ID NOs: 368 and 369; (g) SEQ ID NOs: 378 and 379; and (h) SEQ ID NOs: 388 and 389. In exemplary instances, the PD-1 antigen-binding protein comprises a constant region comprising an amino acid sequence of any one of SEQ ID NOs: 265-267, 282, 284-311. In some aspects, the PD-1 antigen-binding protein comprises a pair of amino acid sequences selected from the group consisting of: (a) SEQ ID NOs: 320 and 321; (b) SEQ ID NOs: 330 and 331; (c) SEQ ID NOs: 340 and 341; (d) SEQ ID NOs: 350 and 351; (e) SEQ ID NOs: 360 and 361; (f) SEQ ID NOs: 370 and 371; (g) SEQ ID NOs: 380 and 381; and (h) SEQ ID NOs: 390 and 391.

In exemplary embodiments, the present disclosure provides a conjugate comprising a PD-1 antigen-binding protein as described in the foregoing paragraphs and a heterologous moiety. In exemplary embodiments, the present disclosure provides a fusion polypeptide or fusion protein comprising a PD-1 antigen-binding protein as described in the foregoing paragraphs and a heterologous polypeptide or peptide. In exemplary embodiments, the present disclosure provides a nucleic acid comprising a nucleotide sequence encoding the PD-1 antigen-binding protein, the conjugate, or the fusion polypeptide or fusion protein, as described in the foregoing paragraphs. In exemplary instances, the nucleic acid comprises the sequence of any one of SEQ ID NOs: 392-471. The present disclosure in exemplary embodiments provides a vector comprising the nucleic acid, as described above, as well as a host cell comprising the nucleic acid or the vector, as described above. Also provided is a kit comprising a PD-1 antigen-binding protein as described in the foregoing paragraphs, or a conjugate, fusion polypeptide, fusion protein, nucleic acid, vector, or host cell, or a combination thereof, and a container. The present disclosure provides a pharmaceutical composition that in exemplary embodiments comprises a PD-1 antigen-binding protein as described in the foregoing paragraphs, or a conjugate, fusion polypeptide, fusion protein, nucleic acid, vector, or host cell, or a combination thereof, and a pharmaceutically acceptable carrier, excipient, or diluent. The present disclosure further provides a method of making a PD-1 antigen-binding protein, wherein, in exemplary embodiments, the method comprises culturing the host cell as described in this paragraph, so as to express the PD-1 antigen-binding protein and harvesting the expressed PD-1 antigen-binding protein. The present disclosure additionally provides a method of treating a subject in need thereof, wherein, in exemplary embodiments, the method comprises administering to the subject in need thereof a pharmaceutical composition as described in this paragraph in an amount effective to treat the subject. In exemplary aspects, the subject has a solid tumor and the pharmaceutical composition is administered to the subject in an amount effective to treat the solid tumor in the subject. Optionally, the the solid tumor is selected from the group consisting of: head and neck, ovarian, cervical, bladder and oesophageal cancers, pancreatic, gastrointestinal cancer, gastric, breast, endometrial and colorectal cancers, hepatocellular carcinoma, glioblastoma, bladder, lung cancer, e.g., non-small cell lung cancer (NSCLC), bronchioloalveolar carcinoma.

In another aspect, the present invention is directed the following embodiments:

1. A combination comprising:
   (i) an anti-PD-1 antibody, wherein said anti-PD-1 antibody comprises:
      (a) a heavy chain (HC) complementarity-determining region (CDR) 1 amino acid sequence selected from the group consisting of: SEQ ID NOs: 312, 322, 332, 342, 352, 362, 372, and 382, or a variant sequence thereof which differs by only one or two amino acids or which has at least or about 70% sequence identity;
      (b) an HC CDR2 amino acid sequence selected from the group consisting of: SEQ ID NOs: 313, 323, 333, 343, 353, 363, 373, and 383, or a variant sequence thereof which differs by only one or two amino acids or which has at least or about 70% sequence identity;
      (c) an HC CDR3 amino acid sequence selected from the group consisting of: SEQ ID NOs: 314, 324, 334, 344, 354, 364, 374, and 384, or a variant sequence thereof which differs by only one or two amino acids or which has at least or about 70% sequence identity;
      (d) a light chain (LC) CDR1 amino acid sequence selected from the group consisting of: 315, 325, 335, 345, 355, 365, 375, and 385, or a variant sequence thereof which differs by only one or two amino acids or which has at least or about 70% sequence identity;
      (e) an LC CDR2 amino acid sequence selected from the group consisting of: 316, 326, 336, 346, 356, 366, 376, and 386, or a variant sequence thereof which differs by only one or two amino acids or which has at least or about 70% sequence identity;
      (f) an LC CDR3 amino acid sequence selected from the group consisting of: 317, 327, 337, 347, 357, 367, 377, and 387, or a variant sequence thereof which differs by only one or two amino acids or which has at least or about 70% sequence identity; or
      (g) a combination of any two, three, four, five, or six of (a)-(f); and
   (ii) a single chain antibody construct comprising:
      (a) a first domain in the format of an scFv binding to CD3,
      (b) a second domain in the format of an scFv binding to a tumor-associated antigen; and, optionally,
      (c) a third domain providing an extended serum half-life, preferably an Fc-based domain.
2. The combination of embodiment 1, wherein:
   (i) the anti-PD-1 antibody comprises: a heavy chain (HC) CDR1 amino acid sequence comprising or consisting of the sequence of SEQ ID NO: 352, a heavy chain (HC) CDR2 amino acid sequence comprising or consisting of the sequence of SEQ ID NO: 353, a heavy chain (HC) CDR3 amino acid sequence comprising or consisting of the sequence of SEQ ID NO: 354, a light chain (LC) CDR1 amino acid sequence comprising or consisting of the sequence of SEQ ID NO: 355, a light chain (LC) CDR2 amino acid sequence comprising or consisting of the sequence of SEQ ID NO: 356, and a light chain (LC) CDR3 amino acid sequence comprising or consisting of the sequence of SEQ ID NO: 357;
   (ii) the anti-PD-1 antibody has a heavy chain (HC) variable region amino acid sequence comprising or consisting of the sequence of SEQ ID NO: 358 and a light chain (LC) variable region amino acid sequence comprising or consisting of SEQ ID NO: 359; or (iii) has a heavy chain amino acid sequence of SEQ ID NO: 360 and a light chain (LC) amino acid sequence of SEQ ID NO: 361.

3. The combination of embodiment 1 or 2, wherein the tumor-associated antigen of the second domain of the single chain antibody construct is selected from the group consisting of CD19, CD33, PSMA, BCMA, FLT3, EGFRvIII, DLL3, MUC17, and EpCAM.

4. A kit comprising the combination of any one of embodiments 1 to 3.

5. A method of treating a subject in need thereof, comprising administering to the subject in need thereof the combination of any one of embodiments 1 to 3.

6. The method of embodiment 5, wherein the subject has a cancer and the combination of any one of claims 1 to 3 is administered to the subject in an amount effective to treat the cancer in the subject.

7. The combination of any one of embodiments 1 to 3 for therapeutic use.

8. The combination of any one of embodiments 1 to 3 for use in the treatment of cancer.

9. The method of embodiment 6, or the combination for use of embodiment 7 or 8, wherein (a) the tumor-associated antigen of the second domain of the single chain antibody construct is CD19 and the cancer is acute lymphoblastic leukemia (ALL), relapsed or refractory diffuse large B cell lymphoma (DLBCL), mantle cell lymphoma, or follicular lymphoma;

(b) the tumor-associated antigen of the second domain of the single chain antibody construct is CD33 and the cancer is acute myeloid leukemia;

(c) the tumor-associated antigen of the second domain of the single chain antibody construct is PSMA and the cancer is prostate cancer;

(d) the tumor-associated antigen of the second domain of the single chain antibody construct is BCMA and the cancer is multiple myeloma;

(e) the tumor-associated antigen of the second domain of the single chain antibody construct is FLT3 and the cancer is acute myeloid leukemia;

(f) the tumor-associated antigen of the second domain of the single chain antibody construct is EGFRvIII and the cancer is glioblastoma;

(g) the tumor-associated antigen of the second domain of the single chain antibody construct is DLL3 and the cancer is small lung cell cancer;

(h) the tumor-associated antigen of the second domain of the single chain antibody construct is MUC17 and the cancer is gastrointestinal cancer;

(i) the tumor-associated antigen of the second domain of the single chain antibody construct is EpCAM and the cancer is lung cancer (adenocarcinoma and small cell), gastrointestinal cancer, adenocarcinoma of the gastro-esophageal junction, colorectal cancer, breast cancer, hormone-refractory prostate cancer, ovarian cancer, malignant neoplasm of nasopharynx, colon cancer, pancreatic cancer, or esophageal carcinoma; or (j) the tumor-associated antigen of the second domain of the single chain antibody construct is CLND18.2 and the cancer is gastrointestinal cancer.

10. The method or combination for use of embodiment 9, wherein:

(a) the single chain antibody construct according to (a) has the amino acid sequence of SEQ ID NOs: 709, 710, 711, preferably SEQ ID NO: 709;

(b) the single chain antibody construct according to (b) has the amino acid sequence of SEQ ID NOs: 712-717, preferably SEQ ID NOs: 712 and 715;

(c) the single chain antibody construct according to (c) has the amino acid sequence of SEQ ID NOs: 718-723, preferably SEQ ID NOs: 718 and 721;

(d) the single chain antibody construct according to (d) has the amino acid sequence of SEQ ID NOs: 695-700, preferably SEQ ID NOs: 695 and 698;

(e) the single chain antibody construct according to (e) has the amino acid sequence of SEQ ID NOs: 704-706, preferably SEQ ID NO: 704;

(f) the single chain antibody construct according to (f) has the amino acid sequence of SEQ ID NOs: 707 and 708, preferably SEQ ID NO: 707;

(g) the single chain antibody construct according to (g) has the amino acid sequence of SEQ ID NOs: 701-703, preferably SEQ ID NO: 701;

(h) the single chain antibody construct according to (h) has the amino acid sequence of SEQ ID NOs: 724-726, preferably SEQ ID NO: 724; or (i) the single chain antibody construct according to (i) has the amino acid sequence of SEQ ID NOs: 727-729, preferably SEQ ID NO: 727.

Due to the nature of the at least two constituents of the combination, namely their pharmaceutical activity, the combination can also be referred to as a therapeutic combination. In some embodiments, the combination can be in the form of a pharmaceutical composition. The definitions relating to a pharmaceutical composition provided herein above apply mutatis mutandis also to this aspect of the invention as if specifically recited in the following. In another embodiment, the combination can be in the form of a kit comprising the at least two constituents of the combination. In specific embodiments, the kit allows for the simultaneous and/or sequential administration of the constituents of the combination. The definitions relating to a kit provided herein (in the section entitled “Kits”) above apply mutatis mutandis also to this aspect of the invention as if specifically recited in the following.

The anti-PD-1 antibody (or antigen binding antibody fragment thereof) may comprise (a) a heavy chain (HC) complementarity-determining region (CDR) 1 amino acid sequence selected from the group consisting of: SEQ ID NOs: 312, 322, 332, 342, 352, 362, 372, and 382, (see Table D) or a variant sequence thereof which differs by only one or two amino acids or which has at least or about 70% sequence identity; (b) an HC CDR2 amino acid sequence selected from the group consisting of: SEQ ID NOs: 313, 323, 333, 343, 353, 363, 373, and 383, (see Table D) or a variant sequence thereof which differs by only one or two amino acids or which has at least or about 70% sequence identity; (c) an HC CDR3 amino acid sequence selected from the group consisting of: SEQ ID NOs: 314, 324, 334, 344, 354, 364, 374, and 384, (see Table D) or a variant sequence thereof which differs by only one or two amino acids or which has at least or about 70% sequence identity; (d) a light chain (LC) CDR1 amino acid sequence selected from the group consisting of: 315, 325, 335, 345, 355, 365, 375, and 385, (see Table D) or a variant sequence thereof which differs by only one or two amino acids or which has at least or about 70% sequence identity; (e) an LC CDR2 amino acid sequence selected from the group consisting of: 316, 326, 336, 346, 356, 366, 376, and 386, (see Table D) or a variant sequence thereof which differs by only one or two amino acids or which has at least or about 70% sequence identity; (f) an LC CDR3 amino acid sequence selected from the group consisting of: 317, 327, 337, 347, 357, 367, 377, and 387, (see Table D) or a variant sequence thereof which differs by only one or two amino acids or which has at least or about 70% sequence identity; or (g) a combination of any two, three, four, five, or six of (a)-(f).

In some embodiments, the anti-PD-1 antibody is the anti-PD-1 antibody as described herein above in relation to other aspects of the invention, namely any of the anti-PD-1 antibodies described herein above that are defined by the presence of one or more of the amino acid sequence identifiers listed in Tables D and E. Accordingly, in further embodiments, the anti-PD-1 antibody protein product comprises such CDRs as shown in Table D and/or comprises variable light chain (LC) region sequence and variable heavy chain (HC) region sequence combinations, or light chain (LC) and heavy chain (HC) sequence combinations as shown in Table E as defined herein above. In some embodiments, the anti-PD-1 antibody for combination is 20C1.009, wherein said anti-PD-1 antibody comprises: a heavy chain (HC) CDR1 amino acid sequence comprising or consisting of the sequence of SEQ ID NO: 352, a heavy chain (HC) CDR2 amino acid sequence comprising or consisting of the sequence of SEQ ID NO: 353, a heavy chain (HC) CDR3 amino acid sequence comprising or consisting of the sequence of SEQ ID NO: 354, a light chain (LC) CDR1 amino acid sequence comprising or consisting of the sequence of SEQ ID NO: 355, a light chain (LC) CDR2 amino acid sequence comprising or consisting of the sequence of SEQ ID NO: 356, and a light chain (LC) CDR3 amino acid sequence comprising or consisting of the sequence of SEQ ID NO: 357. In other embodiments, the anti-PD-1 antibody has a heavy chain (HC) variable region amino acid sequence comprising or consisting of the sequence of SEQ ID NO: 358 and a light chain (LC) variable region amino acid sequence comprising or consisting of SEQ ID NO: 359; or has a heavy chain amino acid sequence of SEQ ID NO: 360 and a light chain (LC) amino acid sequence of SEQ ID NO: 361.

The single chain antibody construct may be a bispecific single chain antibody construct. In a particular embodiment, the antibody construct for combination with the anti-PD-1 antibody (e.g., 20C1.009) is in the format of a bispecific single chain antibody construct.

The bispecific single chain antibody construct referred to herein may further be characterized in that a peptide linker is located between the first and second domain. Hence, it is a single chain polypeptide or a single chain antibody construct comprising, a) a first domain in the format of an scFv,
b) a peptide linker, preferably a glycine/serine linker,
c) a second domain in the format of an scFv; and, optionally,
d) a third domain providing an extended serum half-life, preferably a Fc-based domain.

Hence, a single chain antibody construct denotes a single polypeptide chain comprising (at least) two domains in the format of an scFv (also referred to as binding domains). In line with the foregoing, each binding domain comprises a variable region from an antibody heavy chain ("VH or H region") and a variable region from an antibody light chain ("VL or L region"), wherein the single chain antibody construct specifically bind to the CD3 and a tumor associated antigen (TAA) via the binding domains. The two binding domains may be linked to one another by a linker, preferably a peptide linker. A non-limiting example for a peptide linker is Gly-Gly-Gly-Gly-Ser (G-G-G-G-S) and repeats thereof. The VH region and VL region within each of the first and second binding domains may be linked to one another via a peptide linker, for example of the type disclosed and claimed in EP 623679 B1, but in any case long enough to allow the VH region and VL region of the first binding domain and the VH region and VL region of the second binding domain to pair with one another such that, together, they are able to specifically bind to the respective targets of the first and second binding domains, namely CD3 and a TAA. Exemplarily, anti-CD19×anti-CD3 single chain antibody constructs are described in great detail in WO 99/54440 and WO 2004/106381 and WO2008/119565. For the avoidance of doubt, the single chain antibody construct includes at least two binding domains, but may include further binding domains and/or alternative functional domains. Thus, tri- or multispecific single chain antibody constructs are encompassed, and the single chain antibody constructs are not limited. Given that the single chain antibody constructs comprise one domain binding to a tumor-associated antigen (also referred to herein as "TAA") and another domain binding to CD3, they do not occur naturally, and they are markedly different in their function from naturally occurring products. A single chain antibody construct is hence an artificial "hybrid" molecule comprising at least two distinct binding domains with different specificities.

As described herein above, one domain of the single chain antibody construct binds to CD3. More preferably, it binds to CD3 on the surface of a T cell. It is furthermore envisaged that the domain binds to human CD3, preferably to human CD3 on the surface of a T cell. It is also envisaged that the domain binds to CD3 epsilon. More preferably, it binds to human CD3 epsilon, e.g. to human CD3 epsilon on the surface of a T cell. A preferred amino acid sequence for the extracellular domain of human CD3 epsilon is depicted in SEQ ID NO: 577.

In one embodiment of the present invention, one domain of the single chain antibody construct binds to human CD3 epsilon (or human CD3 epsilon on the surface of a T cell) and to *Callithrix jacchus* or *Saimiri sciureus* CD3 epsilon. It is also envisaged that said domain binds to an extracellular epitope of CD3 epsilon, preferably to an extracellular epitope of human CD3 epsilon. It is also envisaged that said domain binds to an extracellular epitope of the human and the *Macaca* CD3 epsilon chain. One preferred epitope of CD3 epsilon is comprised within amino acid residues 1-27 of the human CD3 epsilon extracellular domain (see SEQ ID NO: 578). Even more specifically, the epitope comprises at least the amino acid sequence Gln-Asp-Gly-Asn-Glu. Binders having such characteristics are described in detail in WO 2008/119567.

Antibodies or bispecific antibody constructs directed against (human) CD3 or specifically against CD3 epsilon are known, and their CDRs, VH and VL sequences can serve as a basis for the CD3 binding domain of the single chain antibody construct. For example, Kung et al. reported in 1979 the development of OKT3 (Ortho Kung T3), the first mAb recognizing CD3 (specifically, the epsilon chain of CD3) on human T cells. OKT3 (muromonab) was the first monoclonal antibody of murine origin to become available for therapy in humans. Newer anti-CD3 monoclonal antibodies include otelixizumab (TRX4), teplizumab (MGA031), foralumab and visilizumab, all targeting the epsilon chain of CD3. Bispecific antibody constructs directed against a (cancer) target and CD3 are also being developed and (pre-)clinically tested, and their CD3 binding domain (CDRs, VH, VL) may serve as a basis for the CD3 binding domain of the bispecific single chain antibody construct. Examples include, but are not limited to, blinatumomab, solitomab (MT110, AMG 110), catumaxomab, duvortuxizumab, ertumaxomab, mosunetuzumab, FBTAO5 (Bi20, TPBs05), CEA-TCB (RG7802, RO6958688), AFM11, and MGD006 (S80880). Other examples of CD3 binding domains are disclosed e.g. in U.S. Pat. No. 7,994,289 B2, U.S. Pat. No. 7,728,114 B2, U.S. Pat. No. 7,381,803 B1, U.S. Pat. No. 6,706,265 B1.

It is envisaged for the single chain antibody construct that the domain which binds to CD3 comprises a VL region comprising CDR-L1, CDR-L2 and CDR-L3 selected from:

(a) CDR-L1 as depicted in SEQ ID NO: 590, CDR-L2 as depicted in SEQ ID NO: 591, and CDR-L3 as depicted in SEQ ID NO: 592;

(b) CDR-L1 as depicted in SEQ ID NO: 647, CDR-L2 as depicted in SEQ ID NO: 648, and CDR-L3 as depicted in SEQ ID NO: 649; and (c) CDR-L1 as depicted in SEQ ID NO: 669, CDR-L2 as depicted in SEQ ID NO: 670, and CDR-L3 as depicted in SEQ ID NO: 671.

It is also envisaged for the single chain antibody construct that the domain which binds to CD3 comprises a VH region comprising CDR-H1, CDR-H2 and CDR-H3 selected from:

(a) CDR-H1 as depicted in SEQ ID NO: 582, CDR-H2 as depicted in SEQ ID NO: 583, and CDR-H3 as depicted in SEQ ID NO: 584;

(b) CDR-H1 as depicted in SEQ ID NO: 593, CDR-H2 as depicted in SEQ ID NO: 594, and CDR-H3 as depicted in SEQ ID NO: 595;

(c) CDR-H1 as depicted in SEQ ID NO: 605, CDR-H2 as depicted in SEQ ID NO: 606, and CDR-H3 as depicted in SEQ ID NO: 607;

(d) CDR-H1 as depicted in SEQ ID NO: 616, CDR-H2 as depicted in SEQ ID NO: 617, and CDR-H3 as depicted in SEQ ID NO: 618;

(e) CDR-H1 as depicted in SEQ ID NO: 627, CDR-H2 as depicted in SEQ ID NO: 628, and CDR-H3 as depicted in SEQ ID NO: 629;

(f) CDR-H1 as depicted in SEQ ID NO: 639, CDR-H2 as depicted in SEQ ID NO: 640, and CDR-H3 as depicted in SEQ ID NO: 641;

(g) CDR-H1 as depicted in SEQ ID NO: 650, CDR-H2 as depicted in SEQ ID NO: 651, and CDR-H3 as depicted in SEQ ID NO: 652;

(h) CDR-H1 as depicted in SEQ ID NO: 661, CDR-H2 as depicted in SEQ ID NO: 662, and CDR-H3 as depicted in SEQ ID NO: 663;

(i) CDR-H1 as depicted in SEQ ID NO: 672, CDR-H2 as depicted in SEQ ID NO: 673, and CDR-H3 as depicted in SEQ ID NO: 674; and (j) CDR-H1 as depicted in SEQ ID NO: 687, CDR-H2 as depicted in SEQ ID NO: 688, and CDR-H3 as depicted in SEQ ID NO: 689.

It is furthermore envisaged for the single chain antibody construct that the domain which binds to CD3 comprises a VL region comprising CDR-L1, CDR-L2 and CDR-L3 and a VH region comprising CDR-H1, CDR-H2 and CDR-H3 selected from:

(a) CDR-L1 as depicted in SEQ ID NO: 579, CDR-L2 as depicted in SEQ ID NO: 580, CDR-L3 as depicted in SEQ ID NO: 581, CDR-H1 as depicted in SEQ ID NO: 582, CDR-H2 as depicted in SEQ ID NO: 583, and CDR-H3 as depicted in SEQ ID NO: 584;

(b) CDR-L1 as depicted in SEQ ID NO: 590, CDR-L2 as depicted in SEQ ID NO: 591, CDR-L3 as depicted in SEQ ID NO: 592, CDR-H1 as depicted in SEQ ID NO: 593, CDR-H2 as depicted in SEQ ID NO: 594, and CDR-H3 as depicted in SEQ ID NO: 595;

(c) CDR-L1 as depicted in SEQ ID NO: 602, CDR-L2 as depicted in SEQ ID NO: 603, CDR-L3 as depicted in SEQ ID NO: 604, CDR-H1 as depicted in SEQ ID NO: 605, CDR-H2 as depicted in SEQ ID NO: 606, and CDR-H3 as depicted in SEQ ID NO: 607;

(d) CDR-L1 as depicted in SEQ ID NO: 613, CDR-L2 as depicted in SEQ ID NO: 614, CDR-L3 as depicted in SEQ ID NO: 615, CDR-H1 as depicted in SEQ ID NO: 616, CDR-H2 as depicted in SEQ ID NO: 617, and CDR-H3 as depicted in SEQ ID NO: 618;

(e) CDR-L1 as depicted in SEQ ID NO: 624, CDR-L2 as depicted in SEQ ID NO: 625, CDR-L3 as depicted in SEQ ID NO: 626, CDR-H1 as depicted in SEQ ID NO: 627, CDR-H2 as depicted in SEQ ID NO: 628, and CDR-H3 as depicted in SEQ ID NO: 629;

(f) CDR-L1 as depicted in SEQ ID NO: 636, CDR-L2 as depicted in SEQ ID NO: 637, CDR-L3 as depicted in SEQ ID NO: 638, CDR-H1 as depicted in SEQ ID NO: 639, CDR-H2 as depicted in SEQ ID NO: 640, and CDR-H3 as depicted in SEQ ID NO: 641;

(g) CDR-L1 as depicted in SEQ ID NO: 647, CDR-L2 as depicted in SEQ ID NO: 648, CDR-L3 as depicted in SEQ ID NO: 649, CDR-H1 as depicted in SEQ ID NO: 650, CDR-H2 as depicted in SEQ ID NO: 651, and CDR-H3 as depicted in SEQ ID NO: 652;

(h) CDR-L1 as depicted in SEQ ID NO: 658, CDR-L2 as depicted in SEQ ID NO: 659, CDR-L3 as depicted in SEQ ID NO: 660, CDR-H1 as depicted in SEQ ID NO: 661, CDR-H2 as depicted in SEQ ID NO: 662, and CDR-H3 as depicted in SEQ ID NO: 663;

(i) CDR-L1 as depicted in SEQ ID NO: 669, CDR-L2 as depicted in SEQ ID NO: 670, CDR-L3 as depicted in SEQ ID NO: 671, CDR-H1 as depicted in SEQ ID NO: 672, CDR-H2 as depicted in SEQ ID NO: 673, and CDR-H3 as depicted in SEQ ID NO: 674; and (j) CDR-L1 as depicted in SEQ ID NO: 684, CDR-L2 as depicted in SEQ ID NO: 685, CDR-L3 as depicted in SEQ ID NO: 686, CDR-H1 as depicted in SEQ ID NO: 687, CDR-H2 as depicted in SEQ ID NO: 688, and CDR-H3 as depicted in SEQ ID NO: 689.

It is envisaged for the single chain antibody construct that the domain which binds to CD3 comprises a VL region selected from the group consisting of a VL region as depicted in any one of SEQ ID NO: 598, SEQ ID NO: 599, SEQ ID NO: 633, SEQ ID NO: 655, SEQ ID NO: 677 and SEQ ID NO: 678.

It is also envisaged that the domain which binds to CD3 comprises a VH region selected from the group consisting of a VH region as depicted in any one of SEQ ID NO: 585, SEQ ID NO: 586, SEQ ID NO: 596, SEQ ID NO: 597, SEQ ID NO: 608, SEQ ID NO: 609, SEQ ID NO: 619, SEQ ID NO: 620, SEQ ID NO: 630, SEQ ID NO: 631, SEQ ID NO: 642, SEQ ID NO: 643, SEQ ID NO: 653, SEQ ID NO: 654, SEQ ID NO: 664, SEQ ID NO: 665, SEQ ID NO: 675, SEQ ID NO: 676, SEQ ID NO: 681, SEQ ID NO: 690, and SEQ ID NO: 691.

In specific embodiments, the single chain antibody construct is characterized by a domain which binds to CD3 comprising a VL region and a VH region selected from the group consisting of:

(a) a VL region as depicted in SEQ ID NO: 587 or 599 and a VH region as depicted in SEQ ID NO: 585 or 586;
(b) a VL region as depicted in SEQ ID NO: 598 or 599 and a VH region as depicted in SEQ ID NO: 596 or 597;
(c) a VL region as depicted in SEQ ID NO: 610 or 599 and a VH region as depicted in SEQ ID NO: 608 or 609;
(d) a VL region as depicted in SEQ ID NO: 621 or 599 and a VH region as depicted in SEQ ID NO: 619 or 620;
(e) a VL region as depicted in SEQ ID NO: 632 or 633 and a VH region as depicted in SEQ ID NO: 630 or 631;
(f) a VL region as depicted in SEQ ID NO: 644 or 599 and a VH region as depicted in SEQ ID NO: 642 or 643;
(g) a VL region as depicted in SEQ ID NO: 655 or 633 and a VH region as depicted in SEQ ID NO: 653 or 654;
(h) a VL region as depicted in SEQ ID NO: 666 or 599 and a VH region as depicted in SEQ ID NO: 664 or 665;
(i) a VL region as depicted in SEQ ID NO: 677 or 678 and a VH region as depicted in SEQ ID NO: 675 or 676;
(j) a VL region as depicted in SEQ ID NO: 692 or 678 and a VH region as depicted in SEQ ID NO: 690 or 691; and
(k) a VL region as depicted in SEQ ID NO: 682 and a VH region as depicted in SEQ ID NO: 681.

A preferred embodiment of the above described single chain antibody construct is characterized by the domain which binds to CD3 comprising an amino acid sequence selected from the group consisting of SEQ ID NOs: 588, 589, 600, 601, 611, 612, 622, 623, 634, 635, 645, 646, 656, 657, 667, 668, 679, 680, 683, 693 and 694.

The single chain antibody construct may comprise a domain providing an extended serum half-life. Examples for means or domains to extend serum half-life of the single chain antibody constructs include peptides, proteins or domains of proteins, which are fused or otherwise attached to the antibody constructs. The group of peptides, proteins or protein domains includes peptides binding to other proteins with preferred pharmacokinetic profile in the human body such as serum albumin (see WO 2009/127691). An alternative concept of such half-life extending peptides includes peptides binding to the neonatal Fc receptor (FcRn, see WO 2007/098420), which can also be used in the antibody constructs of the present invention. The concept of attaching larger domains of proteins or complete proteins includes the fusion of human serum albumin, variants or mutants of human serum albumin (see WO 2011/051489, WO 2012/059486, WO 2012/150319, WO 2013/135896, WO 2014/072481, WO 2013/075066) or domains thereof, as well as the fusion of an immunoglobulin constant region (Fc domain) and variants thereof. Such variants of Fc domains are called Fc-based domains and may e.g. be optimized/modified in order to allow the desired pairing of dimers or multimers, to abolish Fc receptor binding (e.g. to avoid ADCC or CDC) or for other reasons. A further concept known in the art to extend the half-life of substances or molecules in the human body is the pegylation of those molecules (such as the antibody constructs described herein).

In one embodiment, the single chain antibody constructs are linked (e.g. via peptide bond) with a fusion partner (such as a protein, polypeptide or peptide), e.g. for the purpose of extending the construct's serum half-life. These fusion partners can be selected from human serum albumin ("HSA" or "HALB") as wells as sequence variants thereof, peptides binding to HSA, peptides binding to FcRn ("FcRn BP"), or constructs comprising an (antibody derived) Fc region. In general, the fusion partners may be linked to the N-terminus or to the C-terminus of the antibody constructs according to the invention, either directly (e.g. via peptide bond) or through a peptide linker such as $(GGGGS)_n$ (wherein "n" is an integer of 2 or greater, e.g. 2 or 3 or 4).

According to one embodiment, the single chain antibody construct comprises (in addition to the first and second domain) a third domain, namely an Fc-based domain as described in WO 2017/134140 (incorporated herein by reference) that extends serum half-life, which comprises two polypeptide monomers, each comprising a hinge, a CH2 and a CH3 domain, wherein said two polypeptide monomers are fused to each other via a peptide linker. It is envisaged that said third domain comprises in an N-terminal to C-terminal order: hinge-CH2-CH3-linker-hinge-CH2-CH3. It is also envisaged that the first and second domains of the single chain antibody construct are fused to the third domain via a peptide linker.

In line with the present invention, a "hinge" is an IgG hinge region. This region can be identified by analogy using the Kabat numbering, see e.g. Kabat positions 223-243. In line with the above, the minimal requirement for a "hinge" are the amino acid residues corresponding to the $IgG_1$ sequence stretch of D231 to P243 according to the Kabat numbering. The terms "CH2" and "CH3" refer to the immunoglobulin heavy chain constant regions 2 and 3. These regions can as well be identified by analogy using the Kabat numbering, see e.g. Kabat positions 244-360 for CH2 and Kabat positions 361-478 for CH3. It is understood that there is some variation between the immunoglobulins in terms of their $IgG_1$ Fc region, $IgG_2$ Fc region, $IgG_3$ Fc region, $IgG_4$ Fc region, IgM Fc region, IgA Fc region, IgD Fc region and IgE Fc region (see, e.g., Padlan, Molecular Immunology, 31(3), 169-217 (1993)). The term Fc region refers to the last two heavy chain constant regions of IgA, IgD, and IgG, and the last three heavy chain constant regions of IgE and IgM. The Fc region can also include the flexible hinge N-terminal to these domains. For IgA and IgM, the Fc region may include the J chain. For IgG, the Fc region comprises immunoglobulin domains CH2 and CH3 and the hinge between the first two domains and CH2. Although the boundaries of the Fc region of an immunoglobulin may vary, an example for a human IgG heavy chain Fc portion comprising a functional hinge, CH2 and CH3 domain can be defined e.g. to comprise residues D231 (of the hinge domain) to P476 (of the C-terminus of the CH3 domain), or D231 to L476, respectively, for $IgG_4$, wherein the numbering is according to Kabat.

The single chain antibody construct referred to herein may hence comprise in an N- to C-terminal order:
(a) the first domain;
(b) a peptide linker;
(c) the second domain;
(d) a peptide linker;
(e) the first polypeptide monomer of the third domain (comprising a hinge, a CH2 and a CH3 domain);
(f) a peptide linker; and
(g) the second polypeptide monomer of the third domain (comprising a hinge, a CH2 and a CH3 domain).

The combination of the anti-PD-1 antibody (e.g, 20C1.009) with single chain antibody constructs is particularly advantageous since it could be demonstrated that single chain antibody constructs showed superior cell killing efficiency when used in combination with the anti-PD-1 antibodies defined herein above (such as 20C1.009). An improvement of cell killing efficiency could be observed for different target cells, such as where target cells were from solid or heme malignancy and also when cells were from tumor types that are not normally recognized as being sensitive to anti-PD-1 treatment (such as, e.g., prostate tumor cells; FIGS. 40A and 40B), as well as when T cells are not limited (E:T ratio of 1:1), suggesting the combination of the anti-PD-1 antibody and a bispecific single chain antibody construct will be effective even in indications characterized by an abundance of T cells. Further, the improvement could be shown in single chain antibody constructs independent of whether or not the constructs contained a half-life extending domain, such as an Fc-based portion. Moreover, it could be shown that single chain antibody constructs consistently induce PD-1 expression in target cells.

In some embodiments, the single chain antibody constructs to be combined with the anti-PD-1 antibody (such as 20C1.009) are single chain antibody constructs that have (at least) a TAA binding domain directed against the TAAs selected from the group consisting of CD19, CD33, PSMA, BCMA, FLT3, EGFRvIII, DLL3, MUC17, CLND18.2, and EpCAM. In such embodiments, the single chain antibody constructs for combination with the anti-PD-1 antibody (e.g., 20C1.009) are anti-CD19×anti-CD3 single chain antibody constructs, anti-CD33×anti-CD3 single chain antibody constructs, anti-PSMA×anti-CD3 single chain antibody constructs, anti-BCMA×anti-CD3 single chain antibody constructs, anti-FLT3×anti-CD3 single chain antibody constructs, anti-EGFRvIII×anti-CD3 single chain antibody constructs, anti-DLL3×anti-CD3 single chain antibody constructs, anti-MUC17×anti-CD3 single chain antibody constructs, anti-CLND18.2×anti-CD3 single chain antibody constructs, and anti-EpCAM×anti-CD3 single chain antibody constructs.

In other embodiments, the invention relates to a method of treating a subject in need thereof, comprising administering to the subject in need thereof the combination of embodiments 1 to 3. In some embodiments, the subject has a cancer and the combination of any one of embodiments 1 to 3 is administered to the subject in an amount effective to treat the cancer in the subject. As such, said combination is for therapeutic use and it is for use in the treatment of cancer. The definitions for treatment, administration and cancer (including any of the recited cancer types) provided herein above apply mutatis mutandis to this a aspect of the invention as if specifically recited in the following.

Anti-CD19×anti-CD3 single chain antibody constructs combined with an anti-PD-1 antibody (e.g., 20C1.009) are used according to the invention for the treatment of acute lymphoblastic leukemia (ALL), relapsed or refractory diffuse large B cell lymphoma (DLBCL), mantle cell lymphoma, and/or follicular lymphoma. The rationale for the treatment of said cancers with anti-CD19×anti-CD3 single chain antibody constructs as well as preferred anti-CD19×anti-CD3 single chain antibody constructs are provided in WO 99/54440 and WO 17/134140.

Anti-CD33×anti-CD3 single chain antibody constructs combined with an anti-PD-1 antibody (e.g., 20C1.009) are used according to the invention for the treatment of acute myeloid leukemia and myelodysplastic syndrome. The rationale for the treatment of said cancer with anti-CD33×anti-CD3 single chain antibody constructs as well as preferred anti-CD33×anti-CD3 single chain antibody constructs are described in WO 2008/119567 and WO 2017/134140.

Anti-PSMA×anti-CD3 single chain antibody constructs combined with an anti-PD-1 antibody (e.g., 20C1.009) are used according to the invention for the treatment of prostate cancer. The rationale for the treatment of said cancer with anti-PSMA×anti-CD3 single chain antibody constructs as well as preferred anti-PSMA×anti-CD3 single chain antibody constructs are described in WO 2010/037836 and WO 2017/134158.

Anti-BCMA×anti-CD3 single chain antibody constructs combined with an anti-PD-1 antibody (e.g., 20C1.009) are used according to the invention for the treatment of multiple myeloma. The rationale for the treatment of said cancer with anti-BCMA×anti-CD3 single chain antibody constructs as well as preferred anti-BCMA×anti-CD3 single chain antibody constructs are described in WO 2013/072406 and WO 2017/134134.

Anti-FLT3×anti-CD3 single chain antibody constructs combined with an anti-PD-1 antibody (e.g., 20C1.009) are used according to the invention for the treatment of acute myeloid leukemia and myelodysplastic syndrome. The rationale for the treatment of said cancer with anti-FLT3×anti-CD3 single chain antibody constructs as well as preferred anti-FLT3×anti-CD3 single chain antibody constructs are described in WO 2017/021362.

Anti-EGFRvIII×anti-CD3 single chain antibody constructs combined with an anti-PD-1 antibody (e.g., 20C1.009) are used according to the invention for the treatment of glioblastoma. The rationale for the treatment of said cancer with anti-EGFRvIII×anti-CD3 single chain antibody constructs as well as preferred anti-EGFRvIII×anti-CD3 single chain antibody constructs are described in WO 2017/021370.

Anti-DLL3×anti-CD3 single chain antibody constructs combined with an anti-PD-1 antibody (e.g., 20C1.009) are used according to the invention for the treatment of small cell lung cancer and DLL3-expressing neuroendocrine tumors. The rationale for the treatment of said cancer with anti-DLL3×anti-CD3 single chain antibody constructs as well as preferred anti-DLL3×anti-CD3 single chain antibody constructs are described in WO 2017/021349.

Anti-MUC17×anti-CD3 single chain antibody constructs combined with an anti-PD-1 antibody (e.g., 20C1.009) are used according to the invention for the treatment of gastro-intestinal cancers. The rationale for the treatment of said cancers with anti-MUC17×anti-CD3 single chain antibody constructs as well as preferred anti-MUC17×anti-CD3 single chain antibody constructs are described in PCT/US18/68118.

Anti-EpCAM×anti-CD3 single chain antibody constructs combined with an anti-PD-1 antibody (e.g., 20C1.009) are used according to the invention for the treatment of lung cancer (adenocarcinoma and small cell), gastrointestinal cancer, adenocarcinoma of the gastro-esophageal junction, colorectal cancer, breast cancer, hormone-refractory prostate cancer, ovarian cancer, malignant neoplasm of nasopharynx, colon cancer, pancreatic cancer, or esophageal carcinoma. The rationale for the treatment of said cancers with anti-EpCAM×anti-CD3 single chain antibody constructs as well as preferred anti-EpCAM×anti-CD3 single chain antibody constructs are described in WO 2005/040220.

Furthermore, single chain antibody constructs as referred to herein may be bivalent and polyvalent/multivalent constructs as well as bispecific and polyspecific/multispecific constructs, which specifically bind to two, three or more antigenic structures, through distinct binding domains. Such constructs can have more binding valences than specificities, e.g. in a case where it has two binding domains for the first target and one binding domain for the second target (CD3), or vice versa, in which case the construct is trivalent and bispecific. In general, the term “bispecific” as used in relation to the bispecific single chain antibody construct referred to herein includes the meaning that said construct binds to (at least) two different antigens, one of which is CD3 and another is a TAA.

The bispecific single chain antibody constructs of the present invention are preferably "in vitro generated bispecific single chain antibody constructs" and/or "recombinant bispecific single chain antibody constructs". In the context of the present invention, the term "in vitro generated" refers to a bispecific single chain antibody construct according to the above definition where all or part of the binding domain or of a variable region (e.g., at least one CDR) is generated in a non-immune cell selection, e.g., in an in vitro phage display, on a protein chip or in any other method in which candidate amino acid sequences can be tested for their ability to bind to an antigen. This term thus preferably excludes sequences generated solely by genomic rearrangement in an immune cell in an animal. It is envisaged that the first and/or second domain of the bispecific single chain antibody construct is produced by or obtainable by phage display or library screening methods rather than by grafting CDR sequences from a pre-existing (monoclonal) antibody into a scaffold. A "recombinant bispecific single chain antibody construct" is a bispecific single chain antibody construct generated or produced using (inter alia) recombinant DNA technology or genetic engineering.

The bispecific single chain antibody constructs are envisaged to be monoclonal. As used herein, antibodies or antibody constructs that are denominated "monoclonal" (mAb) are obtained from a population of substantially homogeneous antibodies/antibody constructs, i.e., the individual antibodies/antibody constructs comprised in the population are identical (in particular with respect to their amino acid sequence) except for possible naturally occurring mutations and/or post-translational modifications (e.g., isomerizations, amidations) that may be present in minor amounts. Monoclonal antibodies/antibody constructs are highly specific, being directed against a single epitope within the antigen, in contrast to polyclonal antibody preparations which typically include different antibodies directed against different determinants (or epitopes). In addition to their specificity, monoclonal antibodies are advantageous in that they are synthesized by the hybridoma culture, hence uncontaminated by other immunoglobulins. The modifier "monoclonal" indicates the character of the antibody/antibody construct as being obtained from a substantially homogeneous population of antibodies, and is not to be construed as requiring production of the antibody by any particular method.

In the context of this aspect of the present invention, the term "epitope" refers to the part or region of the antigen that is recognized/immunospecifically recognized by the binding domain. An "epitope" is antigenic, and thus the term epitope is sometimes also referred to as "antigenic structure" or "antigenic determinant". The part of the binding domain that binds to the epitope is called a paratope. Specific binding is believed to be accomplished by specific motifs in the amino acid sequence of the binding domain and the antigen. Thus, binding is achieved as a result of their primary, secondary and/or tertiary structure as well as the result of potential secondary modifications of said structures. The specific interaction of the paratope with its antigenic determinant may result in a simple binding of said site to the antigen. In some cases, the specific interaction may alternatively or additionally result in the initiation of a signal, e.g. due to the induction of a change of the conformation of the antigen, an oligomerization of the antigen, etc.

Methods to produce bispecific single chain antibody constructs are well known to the skilled artisan. For example, it is known that for "single chain Fv" (scFv) the two domains of the Fv fragment, VL and VH, are coded for by separate genes, but they can be joined, using recombinant methods, by an artificial linker—as described hereinbefore—that enables them to be made as a single protein chain in which the VL and VH regions pair to form a monovalent molecule; see e.g., Huston et al. (1988) Proc. Natl. Acad. Sci USA 85:5879-5883). These antibody fragments are obtained using conventional techniques known to those with skill in the art, and the fragments are evaluated for function in the same manner as are full-length antibodies or IgGs. A single-chain variable fragment (scFv) is hence a fusion protein of the variable region of the heavy chain (VH) and of the light chain (VL) of immunoglobulins, usually connected with a short linker peptide. The linker is usually rich in glycine for flexibility, as well as serine or also threonine for solubility (as described herein above). This protein retains the specificity of the original immunoglobulin, despite removal of the constant regions and introduction of the linker.

Techniques described for producing single chain antibody constructs (see, inter alia, U.S. Pat. No. 4,946,778, Kontermann and Diibel (2010), loc. cit. and Little (2009), loc. cit.) can be adapted to produce single chain antibody constructs specifically recognizing (an) elected target(s).

Bivalent (also called divalent) or bispecific single-chain variable fragments (bi-scFvs or di-scFvs) having the format $(scFv)_2$ can be engineered by linking two scFv molecules (e.g. with linkers as described hereinbefore). The linking can be done by producing a single polypeptide chain with two VH regions and two VL regions, yielding tandem scFvs (see e.g. Kufer P. et al., (2004) Trends in Biotechnology 22(5): 238-244).

It is also envisaged that the bispecific single chain antibody construct of the invention has, in addition to its function to bind to the target molecules, namely the tumor-associated antigen (TAA) and CD3, a further function. In this format, the antibody construct may be a trifunctional or multifunctional antibody construct by targeting target cells through TAA binding, mediating cytotoxic T cell activity through CD3 binding and providing a further function such as means or domains to enhance or extend serum half-life, a fully functional or modified Fc constant domain mediating ADCC through recruitment of effector cells, a label (fluorescent etc.), a therapeutic agent such as a toxin or radionuclide, a further domain for binding to a further TAA, etc.

The following examples are given merely to illustrate the present disclosure and not in any way to limit its scope.

EXAMPLES

Example 1

This example demonstrates that combination therapy comprising a PD-1 blocking antibody and recombinant IL-21 is superior to a corresponding monotherapy.

In a preclinical study, the effects of a combination treatment of a monoclonal PD-1 blocking antibody and recombinant murine IL-21 (rmIL-21) was compared to the effects of monotherapy treatment of either the PD-1 blocking antibody or the rmIL-21.

On Day 1, CT26/3E5 colon carcinoma cells were implanted into BALB/cmice to initiate tumor growth. On Day 12, tumors were measured and the mice were randomized into 4 groups (10 mice per group): Group 1 received an intraperitoneal (IP) injection of 300 μg isotype control antibody (mIgG1), Group 2 received an IP injection of 300 μg of a blocking PD-1 antibody, Group 3 received 50 μg rmIL-21, and Group 4 received both of the blocking PD-1 antibody (300 μg) and rmIL-21 (50 μg). Groups 1, 2, and 4 received antibody once every 3 days, and Groups 3 and 4 received rmIL-213× per week for 3 weeks. Dosing ended on Day 33.

Tumor volume was monitored throughout the study. As shown in FIGS. 1A-1D, tumor size increased to the greatest extent for Group 1 and to the least extent for Group 4.

Figure 1A:
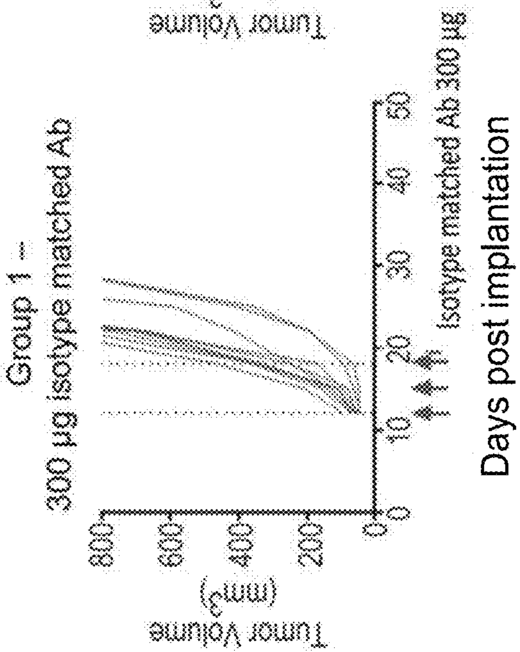
FIG. 1A represents a graph of the tumor volume ($mm^3$) of BALB/c mice implanted with CT26/3E5 colon carcinoma cells as a function of time (days). On Day 12, tumors were measured and the mice were given an intraperitoneal (IP) injection of 300 μg isotype control antibody (mIgG1) on day 12, 15 and 18.
Figure 1B:
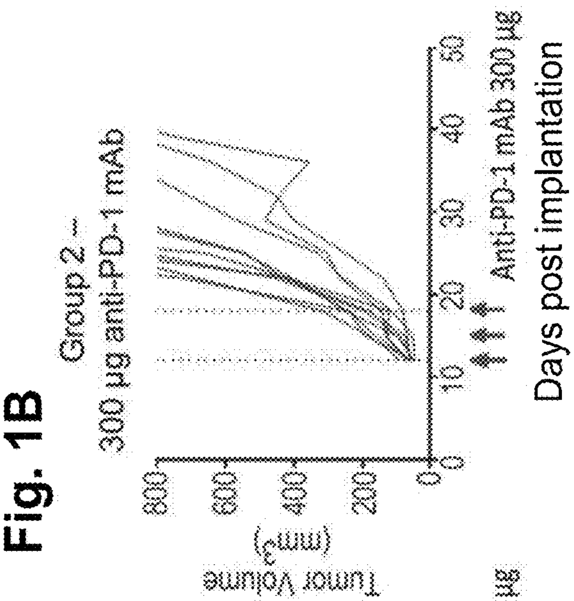
FIG. 1B represents a graph of the tumor volume ($mm^3$) of BALB/c mice implanted with CT26/3E5 colon carcinoma cells as a function of time (days). On Day 12, tumors were measured and the mice were given an IP injection of 300 μg of an anti-PD-1 antibody on day 12, 15 and 18.
Figure 1C:
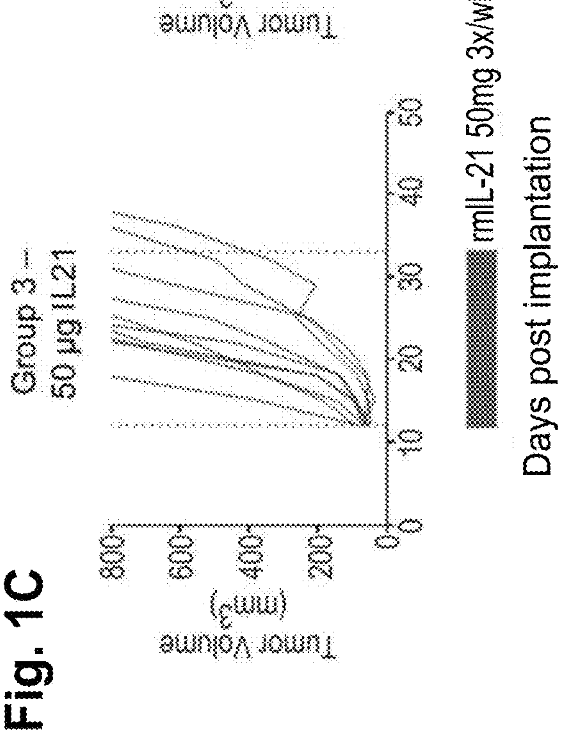
FIG. 1C represents a graph of the tumor volume ($mm^3$) of BALB/c mice implanted with CT26/3E5 colon carcinoma cells as a function of time (days). On Day 12, tumors were measured and the mice were given 50 μg recombinant murine IL-21 (rmIL-21) three times per week for 3 weeks. Dosing ended on Day 33
Figure 1D:
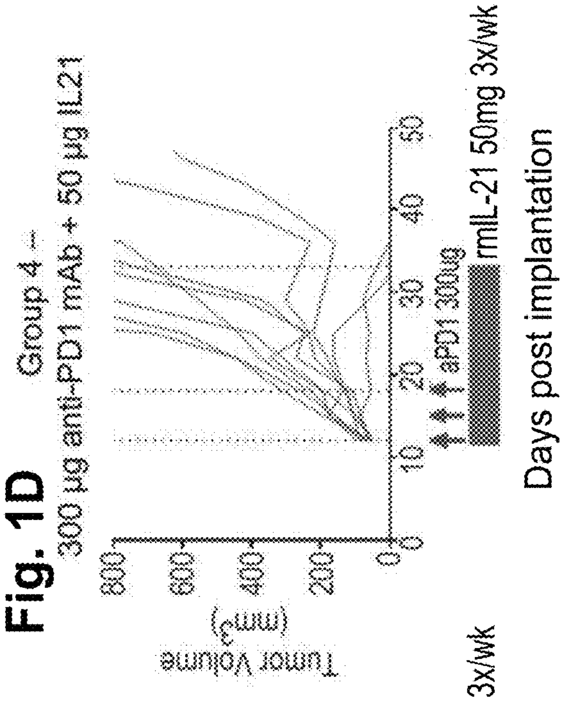
FIG. 1D represents a graph of the tumor volume ($mm^3$) of BALB/c mice implanted with CT26/3E5 colon carcinoma cells as a function of time (days). On Day 12, tumors were measured and the mice were given 300 μg of an anti-PD-1 antibody on day 12, 15 and 18 and 50 μg rmIL-21 three times per week for 3 weeks. Dosing ended on Day 33.
Figure 2:
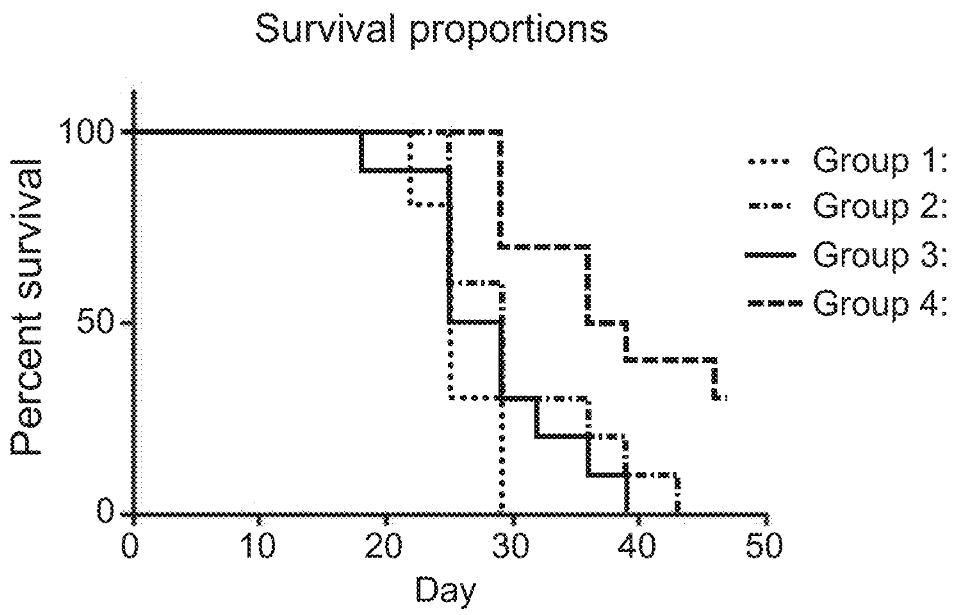
FIG. 2 represents a graph of percent survival of the four groups of BALB/c mice implanted with CT26/3E5 colon carcinoma cells. Group 1 mice were given an intraperitoneal (IP) injection of 300 μg isotype control antibody (mIgG1) on day 12, 15 and 18. Group 2 mice were given an IP injection of 300 μg of an anti-PD-1 antibody on day 12, 15 and 18. Group 3 mice were given 50 μg rmIL-21 three times per week for 3 weeks. Group 4 mice were given 300 μg of an anti-PD-1 antibody on day 12, 15 and 18 and 50 μg rmIL-21 three times per week for 3 weeks. Administration of a combination of anti-PD-1 and rmIL-21 significantly extends survival as compared to monotherapy rmIL-21 or anti-PD-1.

Survival, as measured by the Kaplan Meier log rank mantel cox analysis was the primary endpoint of this study. As shown in FIG. 2 and Table 1, the percent survival and the median survival was greatest for Group 4. Notably, two subjects were tumor free in Group 4 (Table 1).

TABLE 1

| Group | Median Survival (Days) | Subjects Tumor Free |
|---|---|---|
| 1 | 25 | 0 |
| 2 | 29 | 0 |
| 3 | 27 | 0 |
| 4 | 37.5 | 2 |

These results demonstrate that a combination of a monoclonal PD-1 blocking antibody and recombinant mIL-21 provides superior survival advantage versus either component administered alone as monotherapy.

Example 2

This example demonstrates the design and construction of multiple platforms aimed at providing a combination of PD-1 inhibition and IL-21 signaling.

The results obtained in Example 1 demonstrate the advantages of a combinatorial approach of IL-21 signaling and PD-1 inhibition for the treatment of subjects with tumors. Careful consideration of how IL-21 should be delivered was required, however, because of IL-21's ability to both potentiate CD8 T cell responses and suppress antigen presentation and T cell priming. In addition, IL-21R is broadly expressed in human tissues (e.g., by antigen presenting cells (APCs), NK, B, and T cells), thus requiring careful consideration to avoid off target effects (e.g., IL-21 activity outside a tumor environment) and clearance of IL-21 as it binds its receptor in different tissues.

A two pronged approach to address the above considerations was devised. First, IL-21 muteins with attenuated activity—via reduced binding of the IL-21 muteins to IL-21R—were generated. It was envisioned that such IL-21 muteins would have reduced activity when diffused throughout the body, but that such activity would be "rescued" if the IL-21 muteins could be concentrated in target (e.g., cancer) T cells. That is, the IL-21 muteins, once present and concentrated in target cells would, in the aggregate, exhibit therapeutic IL-21 activity. Second, the IL-21 muteins were fused to a targeting arm, such as a monoclonal antibody, in order to target the IL-21 muteins to relevant cells (e.g., cancer cells). In order to deliver the IL-21 muteins to a target cancer cell, they were fused to an anti-PD-1 mAb. The use of an anti-PD-1 mAb had the additional benefit of preventing signaling through PD-1/PD-L1 (thus acting as a checkpoint inhibitor).

Figure 3:
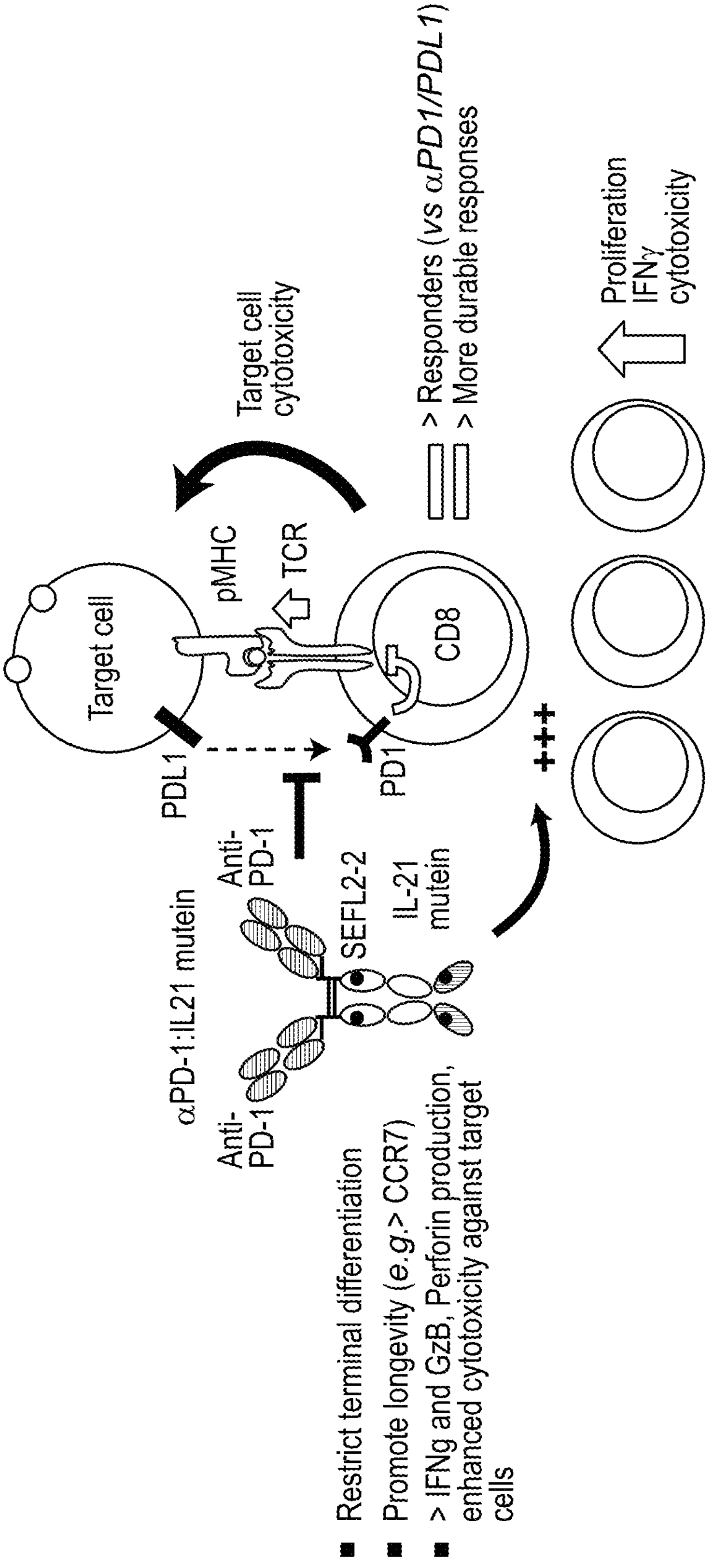
FIG. 3 is an illustration of a hypothesis of the mechanism of action of a fusion protein comprising a blocking PD-1 antibody fused to an IL-21 mutein (αPD-1:IL-21 mutein). Without being bound by a particular theory, it is believed that the fusion binds to IL-21R on CD8+ T cells while simultaneously blocking the signal transduction between PD-1 and PD-L1.

Without being bound by any particular theory, it was hypothesized that a fusion protein comprising an anti-PD-1 antibody fused to an IL-21 mutein would provide a more durable response against cells targeted for destruction. For example, [1] CD8+ T cells expressing PD-1 would be bound by the anti-PD-1 mAb of the fusion protein, and [2] simultaneous binding of the IL-21 mutein of the fusion protein to the IL-21 receptor expressed by the CD8+ T cells would lead to increased proliferation of the T cells as well as greater IFNγ production and secretion by the T cells, which would improve the overall cytotoxicity against the target cells. It was further hypothesized that intracellular signaling pathways activated by IL-21 would prevent terminal differentiation and associated loss of effector function and apoptosis. See FIG. 3.

Additional design considerations included the valency of the mAb (e.g., monovalent or bivalent mAb), requirement for Fc-effector function, site for cytokine fusion (C or N terminus of mAb), inclusion of a linker, and remediation of predicted secondary modification or clipping sites.

Several fusion protein formats were considered and four fusion constructs were cloned and expressed for proof of concept experiments. Wild-type (WT) IL-21 was fused to the C-terminus of an IgG of a bivalent PD-1 mAb as (1) an IL-21 homodimer without any linker; (2) an IL-21 homodimer with a GGGGS (SEQ ID NO: 262) linker; (3) an IL-21 monomer without any linker, but with charge pair mutations in the IgG Fc to drive heterodimerization; and (4) an IL-21 monomer with both a GGGGS (SEQ ID NO: 262) linker and charge pair mutations. All four fusion protein constructs included the following modifications in the mAb Fc-region, numbered according to the EU system: N297G, R292C, V302C (SEFL2-2 mutations). The charge pair mutations used were the V1 mutations (i.e., K409D & K392D in one heavy chain and D399K & E356K in the other heavy chain). All four fusion protein constructs were designed to have a C-terminal lysine removed to prevent clipping.

The fusion constructs were screened for IL-21 activity in cell assays using two variants (PD-$1^{+ve}$ and PD-$1^{-ve}$) of an IL-21R-positive (IL-21R+) Hut78 T cell line. In each cell line, STAT3 phosphorylation was measured as a surrogate measure of IL-21 activity. Both Hut78 cell variants was exposed to (i) recombinant human IL-21 (rhIL-21) alone, (ii) anti-PD-1 mAb alone, (iii) anti-PD-1 mAb fused to an IL-21 homodimer with a linker, (iv) anti-PD-1 mAb fused to an IL-21 homodimer without a linker, (v) anti-PD-1 mAb fused to an IL-21 monomer with a linker or (vi) anti-PD-1 mAb fused to an IL-21 monomer without a linker. The results of the STAT3 phosphorylation assay and the EC50s of each molecule for STAT signaling are shown in FIGS. 5A and 5B and Table 2, respectively.

TABLE 2

| Molecule | PD-$1^{-ve}$ EC50 (pM) | PD-$1^{+ve}$ EC50 (pM) |
|---|---|---|
| rhIL-21 | 153 | 204 |
| Anti-PD-1 mAb | — | — |
| Fusion of Anti-PD-1 mAb + IL-21 homodimer, no linker | 1184 | 97 |
| Fusion of Anti-PD-1 mAb + IL-21 homodimer, +linker | 1822 | 60 |
| Fusion of Anti-PD-1 mAb + IL-21 monomer, no linker | 523 | 70 |
| Fusion of Anti-PD-1 mAb + IL-21 monomer, +linker | 392 | 58 |

Figures 5A, 5B:
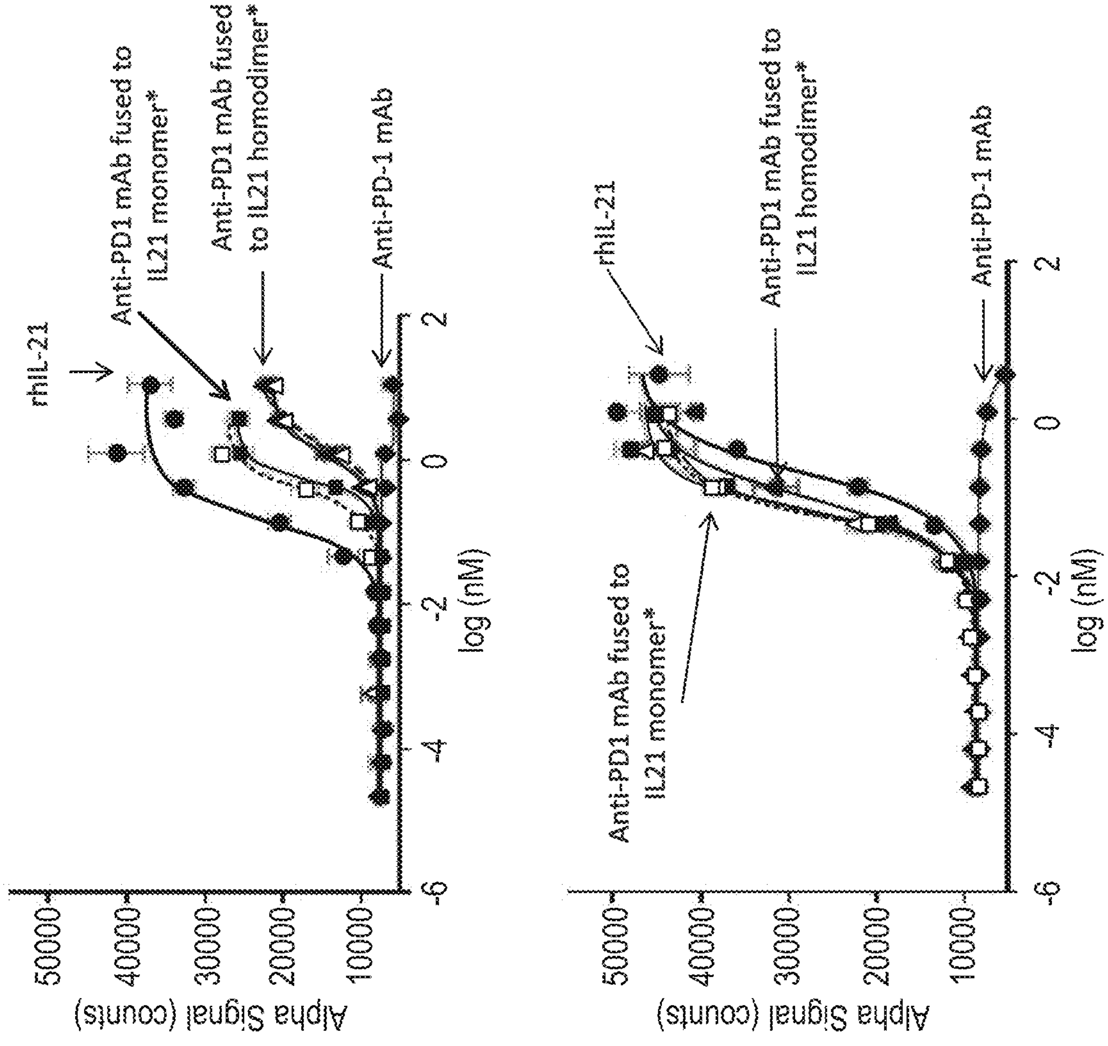
FIG. 5A represents a graph of the STAT3 signaling in PD-$1^{-ve}$ Hut78 T cells exposed to (i) recombinant human IL-21 (rhIL-21) alone (solid line with closed circles), (ii) anti-PD-1 mAb alone (solid line with closed diamonds), (iii) anti-PD-1 mAb fused to an IL-21 homodimer without linker (solid line with closed triangles), (iv) anti-PD-1 mAb fused to an IL-21 homodimer with linker (dashed line with open triangles), (v) anti-PD-1 mAb fused to an IL-21 monomer without linker (solid line with closed squares), or (vi) anti-PD-1 mAb fused to an IL-21 monomer with a linker (dashed line with open squares).
FIG. 5B represents a graph of the STAT3 signaling in PD-$1^{+ve}$ Hut78 T cells exposed to (i) recombinant human IL-21 (rhIL-21) alone (solid line with closed circles), (ii)

As shown in FIG. 5A and Table 2 (middle column), the fusion protein comprising an anti-PD-1 mAb with an IL-21 homodimer exhibited 10-fold less potency relative to rhIL-21 in PD-$1^{-ve}$ cells. rhIL-21 was also more potent as compared to the fusion protein comprising the IL-21 monomer. Despite having only one IL-21 moiety, the monomeric fusion protein showed greater potency relative to the homodimer having two IL-21 moieties. These results suggest that the monomer exhibits higher IL-21 activity in PD-$1^{-ve}$ cells and/or suggest that the homodimer fusion protein format may confer partial attenuation of IL-21 activity (e.g., possibly through steric interactions between IL-21 moieties).

This study also allowed for evaluation of the linker between the IL-21 portion and the IgG C-terminus. As shown in Table 2 (middle column) and FIGS. 5A and 5B (solid line=no linker; dotted line=linker), the presence of a linker does not seem to affect IL-21 activity. Consequently, all future constructs were made without the linker to reduce the amount of non-native sequences in the fusion proteins.

The effect of PD-1 expression on IL-21 activity was evaluated by comparing the results of the STAT3 phosphorylation assay among the PD-$1^{-ve}$ cells and the PD-$1^{+ve}$ cells. As shown in FIG. 5B, the IL-21 activity of each of the IL-21 homodimer and monomer fusion proteins in PD-$1^{+ve}$ cells was essentially the same.

Together, these results demonstrate that IL-21 signaling, in the absence of PD-1 expression in a target cell, can be attenuated by fusing IL-21 to an anti-PD-1 mAb. In addition, IL-21 signaling of an IL-21 fused to an anti-PD-1 mAb is rescued in cells expressing PD-1.

Example 3

This example demonstrates the design, construction, and characterization of multiple IL-21 muteins.

To gain an understanding of the pharmacokinetic/pharmacodynamic (PK/PD) profile of the fusion protein, a fusion protein comprising an IgG fused to a homodimer of WT IL-21 was tested in vivo in a cynomologous monkeys.

The homodimer fusion protein comprising WT IL-21 fused to an anti-PD-1 mAb was intravenously administered to 6 animals at either a low dose (250 μg/kg) or a high dose (1000 μg/kg). An IgG antibody domain (150 μg/kg) was run as a control. Serum concentrations were measured over time, and $C_{max}$, $AUC_{last}$, half-life ($t_{1/2}$), Vss, and Cl were determined. The results are shown in FIG. 6 and Table 3.

TABLE 3

| Animal No. | Dose (μg/kg) | $C_{max}$ (μg/mL) | $AUC_{last}$ (hr * μg/mL) | half-life ($t_{1/2}$) (hr) | Vss (mL/kg) | CL (mL/hr/kg) |
|---|---|---|---|---|---|---|
| 979 | 250 | 78.5 | 331 | 9.99 | 7400 | 635 |
| 980 | 250 | 72.4 | 463 | 10.6 | 7136 | 521 |
| 981 | 250 | 101 | 429 | 19.6 | 8904 | 366 |
| Mean Low Dose | 250 | 84.0 ± 15.1 | 408 ± 69 | 13.4 ± 5.4 | 7813 ± 954 | 507 ± 135 |
| 982 | 1000 | 401 | 3500 | 43 | 6943 | 281 |
| 983 | 1000 | 414 | 2746 | 21.2 | 6953 | 361 |
| 984 | 1000 | 486 | 4345 | 25.0 | 4996 | 226 |
| Mean High Dose | 1000 | 434 ± 45.8 | 3530 ± 800 | 29.7 ± 11.6 | 6297 ± 1127 | 289 ± 67.9 |

Relative to the IgG control (data not shown), the homodimer fusion protein comprising an anti-PD-1 mAb and WT IL-21 exhibited increased clearance and lower exposures. It was thus determined that, in order to enhance exposure of the fusion protein and to minimize off-target IL-21 effects (i.e., minimize IL-21 signaling at immune cells which do not express the PD-1 receptor), mutagenesis of IL-21 to attenuate signaling through the IL-21R would be needed. Accordingly, a fusion protein comprising a mutated IL-21 was designed to bind less strongly to IL-21R on cells that did not express PD-1. It was hypothesized that the fusion protein would first bind PD-1 target (by binding anti-PD-1 antibody binding) with high affinity which would then drive the second lower affinity interaction between the IL-21 mutein and IL-21R (alpha chain). In the absence of PD-1 receptor it was hypothesized that fusion proteins would not bind to cells not expressing PD-1 receptor, irrespective of IL-21R expression.

Structure guided engineering was used to create a panel of 141 IL-21 muteins, each having a single amino acid substitution compared to the WT IL-21 amino acid sequence. Each mutein was designed to have reduced affinity for either the alpha subunit of the IL-21R (101 muteins) or the gamma subunit of IL-21R (40 muteins). Each mutein of the panel was expressed as a fusion protein with a PD-1 mAb (PD-1×IL-21 mutein), and subsequently assessed for its ability to bind to IL-21R using the ForteBio Octet® system (Pall FortdBio; Fremont, Calif.) and screened for activity using the IL-21R+ T cell line (Hut78) using STAT3 phosphorylation as a surrogate for IL-21 activity. To select muteins which have the least potential for off-target activity, selection criteria was set at a greater than 20-fold attenuation in IL-21 signaling vs rhIL-21 at 3.7 nM on PD-$1^{-ve}$ cells.

A complete list of the 141 muteins is shown in Table 4.

TABLE 4

| Mutant | IL-21 AA substitution | SEQ ID NO: | IL-21 α chain or γ chain mutein | IL-21R-Fc Kd (nM) | Fold Affinity Reduction |
|---|---|---|---|---|---|
| 1 | R5D | 74 | α | NB | |
| 2 | R5E | 75 | α | NB | |
| 3 | R5G | 76 | α | NB | |
| 4 | R5H | 77 | α | WB | |
| 5 | R5I | 78 | α | WB | |
| 6 | R5K | 79 | α | WB | |
| 7 | R5L | 80 | α | WB | |
| 8 | R5M | 81 | α | WB | |
| 9 | R5N | 82 | α | NB | |
| 11 | R5S | 84 | α | WB | |
| 12 | R5T | 85 | α | WB | |
| 13 | R5V | 86 | α | WB | |

TABLE 4-continued

| Mutant | IL-21 AA substitution | SEQ ID NO: | IL-21 α chain or γ chain mutein | IL-21R-Fc Kd (nM) | Fold Affinity Reduction |
|---|---|---|---|---|---|
| 14 | R5Y | 87 | α | WB | |
| 15 | I8A | 88 | α | WB | |
| 16 | I8D | 89 | α | WB | |
| 17 | I8E | 90 | α | NB | |
| 18 | I8G | 91 | α | WB | |
| 19 | I8N | 92 | α | WB | |

TABLE 4-continued

| Mutant | IL-21 AA substitution | SEQ ID NO: | IL-21 α chain or γ chain mutein | IL-21R-Fc Kd (nM) | Fold Affinity Reduction |
|---|---|---|---|---|---|
| 22 | R9D | 95 | α | >100 | |
| 23 | R9E | 96 | α | NB | |
| 29 | R9M | 102 | α | WB | |
| 30 | R9N | 103 | α | WB | |
| 31 | R9Q | 104 | α | WB | |
| 32 | R9S | 105 | α | WB | |
| 33 | R9T | 106 | α | WB | |
| 34 | R9V | 107 | α | WB | |
| 24 | R9G | 97 | α | ~40 | |
| 74 | K75D | 156 | α | 19.86 | |
| 79 | R76E | 161 | α | 18.47 | 738.8 |
| 86 | R76N | 168 | α | 15.31 | 612.4 |
| 78 | R76D | 160 | α | ~12 | |
| 77 | R76A | 159 | α | ~11 | 440 |
| 43 | L13D | 112 | α | 11 | 440 |
| 59 | S70P | 138 | α | ~10 | |
| 62 | K72P | 143 | α | 8.958 | |
| 53 | I66P | 132 | α | 7.11 | |
| 21 | R9A | 94 | α | 6.836 | |
| 20 | I8S | 93 | α | ~4 | 160 |
| 52 | I66G | 131 | α | 4.552 | |
| 95 | K77P | 177 | α | 2.056 | |
| 26 | R9I | 99 | α | 2.2 | |
| 42 | Q12V | 249 | α | <2.2 | 88 |
| 70 | K73P | 152 | α | ~2 | 80 |
| 80 | R76G | 162 | α | ~2 | 80 |
| 81 | R76H | 163 | α | ~2 | 80 |
| 56 | V69P | 135 | α | 1.989 | |
| 10 | R5Q | 83 | α | 2.1 | |
| 27 | R9K | 100 | α | 2 | |
| 91 | R76V | 173 | α | 1.765 | |
| 47 | Y23D | 48 | α | 1.7 | 68 |
| 28 | R9L | 101 | α | 1.6 | |
| 96 | P78D | 61 | α | 1.228 | |
| 73 | K73V | 155 | α | 1.071 | |
| 89 | R76S | 171 | α | 1.05 | 42 |
| 76 | K75P | 158 | α | ~1 | 40 |
| 57 | S70E | 136 | α | 0.9481 | |
| 50 | R65P | 129 | α | 0.9 | |
| 88 | R76Q | 170 | α | 0.7702 | |
| 51 | I66D | 130 | α | 0.6773 | |
| 94 | K77G | 176 | α | 0.658 | |
| 85 | R76M | 167 | α | ~0.6 | 24 |
| 35 | R9Y | 108 | α | 0.63 | |
| 58 | S70G | 137 | α | 0.5181 | |
| c6 | D15A | 117 | γ | 0.4389 | |
| 64 | K73D | 146 | α | 0.4354 | |
| c1 | R11D | 109 | γ | 0.4113 | |
| 87 | R76P | 169 | α | ~0.4 | 16 |
| 37 | Q12D | 249 | α | 0.42 | |
| 39 | Q12N | 251 | α | 0.38 | |
| 82 | R76I | 164 | α | 0.3159 | 12.636 |
| 97 | P79D | 62 | α | 0.3152 | |
| 99 | S80P | 179 | α | 0.3089 | |
| 40 | Q12S | 252 | α | 0.32 | |
| 92 | R76Y | 174 | α | 0.2651 | |
| 98 | S80G | 178 | α | 0.265 | |
| 66 | K73G | 148 | α | 0.2528 | |
| 61 | K72G | 142 | α | 0.2502 | |
| c7 | D15E | 118 | | 0.2492 | |
| 41 | Q12T | 253 | α | <0.26 | |

TABLE 4-continued

| Mutant | IL-21 AA substitution | SEQ ID NO: | IL-21 α chain or γ chain mutein | IL-21R-Fc Kd (nM) | Fold Affinity Reduction |
|---|---|---|---|---|---|
| 100 | R5A | 73 | α | 0.2375 | |
| 101 | S70Y | 139 | α | 0.2366 | |
| 60 | K72D | 141 | α | 0.235 | |
| c3 | I14A | 114 | γ | 0.2153 | |
| c8 | D15I | 119 | γ | 0.2151 | |
| 55 | V69G | 134 | α | 0.2148 | |
| 36 | Q12A | 111 | α | 0.23 | |
| c4 | I14D | 115 | γ | 0.2022 | |
| 83 | R76K | 165 | α | ~0.2 | 8 |
| 84 | R76L | 166 | α | ~0.2 | 8 |
| 67 | K73H | 149 | α | 0.1901 | |
| 72 | K73S | 154 | α | 0.1667 | |
| c5 | I14S | 116 | γ | 0.1658 | |
| c9 | D15M | 120 | γ | 0.1633 | |
| 75 | K75G | 157 | α | 0.1627 | |
| 46 | Q19D | 47 | α | 0.17 | |
| c2 | R11S | 110 | γ | 0.1346 | |
| 49 | R65G | 128 | α | 0.13 | |
| 90 | R76T | 172 | α | 0.105 | |
| 44 | I16D | 125 | α | 0.094 | |
| Anti-PD-1 Ab* | — | | | ~0.07-0.092 | |
| 48 | R65D | 127 | α | 0.088 | |
| 25 | R9H | 98 | α | 0.084 | |
| 69 | K73N | 151 | α | 0.07368 | |
| 65 | K73E | 147 | α | 0.07262 | |
| 45 | I16E | 126 | α | 0.076 | |
| 71 | K73Q | 153 | α | 0.06919 | |
| 63 | K73A | 145 | α | 0.0525 | |
| 68 | K73I | 150 | α | 0.1724 | |
| 54 | V69D | 133 | α | 0.03952 | |
| 38 | Q12E | 250 | α | 0.031 | |
| huIL-21** | — | | | 0.025-0.027 | |
| PD-1 Ab*** | — | | | NB | |

NB = no detectable binding

WB = weak binding (below reliable quantification limit)

IL-21 AA substitutions are according to the amino acid position numbering of SEQ ID NO: 1.

*anti-PD-1 mAb fused to human IL-21 (no mutations)

**Not in a fusion; present as human IL-21 only

***Not in a fusion; present as PD-1 Ab only

Exemplary results of the STAT3 phosphorylation assays using IL-21 muteins are shown in FIG. 7 (muteins with reduced affinity for IL-21Rα) and FIG. 8 (muteins with reduced affinity for IL-21Rγ). As shown in these figures, several muteins demonstrated more than a 20-fold attenuation in IL-21 activity in PD-1-ve cells but retained activity in PD-1$^{+ve}$ cells. As shown in FIGS. 9A-9B, mutant 51 (R65P) (solid triangles) was one such mutant that demonstrated a greater than 20× reduction in IL-21 activity in PD$^{-ve}$ cells but exhibited a level of IL-21 activity that was similar to that achieved by rhIL-21 in cells expressing PD-1. A listing of exemplary muteins selected for greater than 20×attenuation of STAT3 signal on PD-1 low/negative cells is provided in Table 5.

TABLE 5

| | | | | | N1 | | N2 | |
|---|---|---|---|---|---|---|---|---|
| Mutant No. | AA Sub. | SEQ ID NO: | Affinity for IL-21R ($K_D$ (nM)) | Fold Affinity Reduction[1] | PD-$1^{-ve}$ fold reduction (rhIL-21) | PD-$1^{+ve}$ fold reduction (rhIL-21) | PD-$1^{-ve}$ fold reduction (rhIL-21) | PD-$1^{+ve}$ fold reduction (rhIL-21) |
| 20 | I8S | 93 | ~4 | 160 | 38.1 | 4.4 | 58.8 | 5.7 |
| 42 | Q12V | 249 | <2.2 | 88 | 80 | 2.4 | 44 | 6.9 |
| 43 | L13D | 112 | 11 | 440 | 83.8 | 2.3 | 25.7 | 2.6 |
| 47 | Y23D | 48 | 1.7 | 68 | 35.6 | 1.4 | 13.7 | 1.4 |
| 70 | K73P | 152 | ~2 | 80 | 46.4 | 1.8 | 21 | 1.7 |
| 76 | K75P | 158 | ~1 | 40 | 25.1 | 1.7 | 36 | 1.6 |
| 77 | R76A | 159 | ~11 | 440 | 29.9 | 2.6 | 20 | 3 |
| 79 | R76E | 161 | 18.47 | 738.8 | 40.2 | 2.6 | 23.2 | 2.5 |
| 80 | R76G | 162 | ~2 | 80 | 31.4 | 1.5 | 17 | 1.6 |
| 81 | R76H | 163 | ~2 | 80 | 23.4 | 1.5 | 38.6 | 1.8 |
| 82 | R76I | 164 | 0.3159 | 12.636 | 25.1 | 1.5 | 28.2 | 1.6 |
| 83 | R76K | 165 | ~0.2 | 8 | 19.3 | 1.7 | 27.4 | 1.4 |
| 84 | R76L | 166 | ~0.2 | 8 | 24.4 | 1.6 | 29.1 | 1.5 |
| 85 | R76M | 167 | ~0.6 | 24 | 21.8 | 1.4 | 28.2 | 1.4 |
| 86 | R76N | 168 | 15.31 | 612.4 | 30.1 | 3 | 21.1 | 4.2 |
| 87 | R76P | 169 | ~0.4 | 16 | 26.5 | 1.7 | 34.4 | 1.6 |
| 89 | R76S | 171 | 1.05 | 42 | 32.7 | 1.3 | 28.9 | 1.1 |
| C10 | D15N | 121 | 11 | 87.3 | 16.9 | 4.1 | 39.7 | 4.7 |
| C12 | D15S | 123 | 6.6 | 52.4 | 16.4 | 3.2 | 36.4 | 3.5 |
| C14 | D15V | 124 | 5.471 | 43.4 | 20.1 | 4.7 | 35 | 5.7 |
| C18 | S113K | 67 | 8.098 | 64.3 | 20.8 | 3.2 | 42 | 3.9 |
| C21 | Q116E | 182 | 7.949 | 63.1 | 26.9 | 5.4 | 52.1 | 6.5 |

[1]vs. rhIL-21

Example 4

This example demonstrates the selection of candidate IL-21 muteins for use in fusion protein construction and the in vivo testing thereof.

The top 22 performing IL-21 muteins were scaled up for further testing. Based on this further testing (in Hut78 pSTAT3 assays as discussed herein), four candidate fusion proteins were selected so that the collection of four would display a range of attenuation (potency shift, relative to rhIL-21, in Hut78 pSTAT3 assay). Mutant C10 (D15N) represented the low attenuation mutein, Mutant 77 (R76A) represented the intermediate attenuation mutein, and Mutants 79 and 78 (R76E and R76D, respectively) represented the high attenuation mutein. Of the four, three were scaled up for an in vivo study in cynomolgus monkeys to evaluate pharmacokinetic properties of the mutein fusion protein constructs. Single doses (10 mg/kg) of Mutant 79 (R76E), Mutant 77 (R76A), or Mutant C10 (D15N) were administered intravenously (bolus) to naïve cynomolgus monkeys and serum concentrations were collected over a ten day period. For comparison, an anti-PD-1 mAb and a fusion protein comprising the anti-PD-1 mAb and WT IL-21 were dosed (individually) to cynomolgus monkeys by intravenous bolus administration. The study was run with two controls: the anti-PD-1 mAb alone and the fusion protein construct comprising the anti-PD-1 mAb and WT IL-21. As shown in FIG. 10, each of the anti-PD-1 mAb-IL-21 mutein fusion proteins exhibited an altered pharmacokinetic profile, compared to the parent anti-PD-1 mAb (black triangles). Table 6 provides the pharmacokinetic properties fit by noncompartmental analysis.

TABLE 6

| Construct | Dose (mg/kg) | $C_{15\ min}$ (μg/mL) | $AUC_{last}$ (hr * μg/mL) | Vss (mL/kg) | CL (mL/hr/kg) | Half-life (hr) |
|---|---|---|---|---|---|---|
| Anti-PD-1 mAb:IL-21(R76E)[a,b] | 10 | 53 ± 7 | 309 ± 50 | 210 ± 30 | 33 ± 5 | 26 ± 13 |
| Anti-PD-1 mAb:IL-21(R76A)[a,b] | 10 | 4.7 ± 1.4 | 28.2 ± 9.3 | 2900 ± 700 | 380 ± 110 | 21 ± 14 |
| Anti-PD-1 mAb:IL-21(D15N)[a,b] | 10 | 2.4 ± 1 | 8.0 ± 2.8 | 10000 ± 4000 | 1400 ± 600 | 15 ± 9 |
| Anti-PD-1 mAb[a,c] | 8.25 | 200 ± 9 | 23600 ± 1500 | 56 ± 5 | 0.20 ± 0.01 | 200 ± 18 |
| Anti-PD-1 mAb:IL-21[c,d] | 1.0 | 0.27 ± 0.02 | 0.32 ± .02 | 5600 ± 800 | 2900 ± 200 | 2.8 ± 0.2 |

[a]Nonhuman primate study
[b]Human IL21 capture with human Fc detection
[c]Human Fc capture with human Fc detection
[d]Nonhuman primate study

Example 5

This example demonstrates the generation of an IL-21 double mutant panel and the expression and characterization of fusion proteins comprising IL-21 double mutant homodimers (unless otherwise specified).

Three muteins having a single amino acid substitution, including (Mutant No. 77 (R76A) and Mutant No. 79 (R76E), were selected for additional engineering based on cell activity data (e.g., highest attenuation of activity on PD-1-e Hut78 T cells) and manufacturability. Structure guided engineering was utilized to generate an additional mutation within the IL-21 single mutant sequence (i.e., to generate a double mutant) to further attenuate cytokine binding to the alpha chain of IL-21R (IL-21Rα). The double mutant sequence was fused to the sequence of an anti-PD-1 mAb, and the fusion proteins were expressed and tested in cell assays. A listing of the double mutant fusion proteins made and tested is provided in Table 7.

TABLE 7

| Double Mutein No. | Amino acid substitutions | SEQ ID NO: |
|---|---|---|
| 1 | D15N, I71L | 214 |
| 2 | D15N, K72A | 215 |
| 3 | D15N, K73A | 216 |
| 4 | D15N, S70T | 213 |
| 5 | I71L, K73Q | 217 |
| 6 | I71L, R76A | 227 |
| 7 | I71L, R76D | 228 |
| 8 | I71L, R76E | 229 |
| 9 | K72A, K73Q | 218 |
| 10 | K72A, R76A | 230 |
| 11 | K72A, R76D | 231 |
| 12 | K72A, R76E | 232 |

TABLE 7-continued

| Double Mutein No. | Amino acid substitutions | SEQ ID NO: |
|---|---|---|
| 13 | K73A, R76A | 233 |
| 14 | K73A, R76D | 234 |
| 15 | K73A, R76E | 235 |
| 17 | S70T, K73Q | 255 |
| 18 | S70T, R76A | 246 |
| 19 | S70T, R76D | 247 |
| 20 | S70T, R76E | 248 |
| 21 | R9E, R76E | 245 |
| 22 | R9A, R76E | 243 |
| 23 | R5E, R76E | 239 |
| 24 | R5A, R76E | 237 |
| 25 | R5Q, R76E | 241 |
| 26 | R9E, R76A | 244 |
| 27 | R9A, R76A | 242 |
| 28 | R5E, R76A | 238 |
| 29 | R5A, R76A | 236 |
| 30 | R5Q, R76A | 240 |

As double mutant fusion proteins with high attenuation properties were desired, the selection criterion was set at a potency ($EC_{50}$) greater than 1000 nM on IL-21R-positive, PD-1-negative (PD-1$^{-ve}$) Hut78 T cells, relative to the potency of rhIL-21. In addition, as with the muteins containing a single amino acid substitution, double mutant fusion proteins were characterized for IL-21R binding (ForteBio Octet). Finally, the double mutant fusion proteins were characterized for PD-1 activity using a Jurkat PD-1 reporter gene assay. The results of these assays are shown in Table 8.

TABLE 8

| Fusion protein tested | pSTAT3 EC50 (nM) in Hut78 PD-$1^+$ T cells (n1) | pSTAT3 EC50 (nM) in Hut78 PD-$1^+$ T cells (n2) | pSTAT3 EC50 (nM) in Hut78 PD-$1^-$ T cells (n1) | pSTAT3 EC50 (nM) in Hut78 PD-$1^-$ T cells (n2) | $K_D$ (nM) Hu IL-21R | $K_D$ (nM) Cyno IL-21R | $K_D$ (nM) Hu PD-1 | $K_D$ (nM) Cyno PD-1 |
|---|---|---|---|---|---|---|---|---|
| rh1L-21 | 0.085 | 0.053 | 0.056 | 0.050 | 0.028-0.037 | 0.019-0.051 | — | — |
| R76A | 0.341 | 0.147 | 100.277 | 35.477 | >10 (biphasic) | >10 (biphasic) | 7.5 | 6.4 |
| R76E | 0.744 | 0.376 | 194.523 | 122.87 | >10 (biphasic) | >10 (biphasic) | 7.2 | 6.0 |
| R76E monomeric | 0.197 | 0.136 | 23.516 | 26.965 | >10 (biphasic) | >10 (biphasic) | 5.8 | 7.3 |
| R5E:R76A | 1.979 | 1.487 | >1000 | >1000 | >300 | >300 | 7.0 | 5.9 |
| R5Q:R76E | 2.211 | 1.663 | >1000 | >1000 | >300 | >300 | 6.3 | 6.3 |
| R9E:R76A | 16.6 | — | >1000 | >1000 | >300 | >300 | 8.9 | 5.9 |
| Anti-PD-1 mAb | — | — | — | — | — | — | 13.4 | 6.3 |

| Fusion protein tested | hPD1 reporter N1 (nM) | hPD1 reporter N2 (nM) |
|---|---|---|
| R76A | 1.44 | 2.17 |
| R76E | 0.85 | 1.68 |
| R76E monomeric | 0.685 | 0.637 |
| R5Q:R76E | 0.954 | 0.942 |
| Anti-PD-1 mAb | 1.39 | 1.77 |

Hu = Human;

Cyno = cynomolgus monkey pSTAT3 EC50 (2.5-fold change)

Octet: Binding to immobilized monovalent Human and Cyno IL-21R-his

As shown in Table 8, the double mutant fusion proteins exhibited very low IL-21 activity on T cells expressing low levels of PD-1 (e.g., below detectable levels of PD-1) but retained significant IL-21 activity on PD-1-expressing cells. The double mutant fusion proteins exhibited weak binding to IL-21R (Kd>300 nM), but retained the ability to bind to PD-1 and block PD-1 signaling.

Example 6

This example demonstrates an in vitro primary cell assay comparing a fusion protein comprising an anti-PD-1 mAb and either an IL-21 double mutant homodimer or an IL-21 single mutant homodimer.

A fusion protein comprising an anti-PD-1 mAb and IL-21 with R5Q and R76E amino acid substitutions was tested in an in vitro primary cell assay (a mixed lymphocyte reaction (MLR)). The MLR comprised a mixed population of IL-21R$^+$ cells, including dendritic cells (DCs) expressing IL-21R but not expressing PD-1, T cells expressing PD-1, and T cells not expressing PD-1. The MLR was exposed to (i) the fusion protein comprising R5Q and R76E amino acid substitutions, (ii) the fusion protein comprising only the R76E amino acid substitution, (iii) recombinant human IL-21 (rHu IL-21), (iv) anti-PD-1 mAb, (v) a combination of rHu IL-21 and anti-PD-1 mAb, or (vi) a control IgG.

As shown in FIG. 11, rhIL-21 suppressed DC function and is dominant over the PD-1 response when co-dosed. The fusion protein comprising the IL-21 double mutein with attenuated activity exhibited reduced off-target activity. Also, each of rhIL-21 and the fusion protein comprising only R76E amino acid substitution exhibited significant off-target activity on DCs and suppressed cytokine production. In contrast, the PD-1 mAb and fusion protein comprising R5Q and R76E amino acid substitutions only delivered IL-21 signals to target PD-1$^{+ve}$ T cells (and not PD-1$^{-ve}$ dendritic cells) and retained the ability (through the PD-1 arm) to augment cytokine production. Accordingly, these results suggest that fusion proteins comprising the IL-21 double mutant have reduced immune-suppression and detrimental impacts on DC priming and may allow for the recruitment of new T cell clones and more durable antitumor immune responses.

Example 7

This example demonstrates the activity of different fusion proteins comprising IL-21 double muteins (homodimers) and an anti-PD-1 mAb on primary cytotoxic T lymphocytes (CTLs). Endogenous STAT3 phosphorylation in primary CTLs (CMV-reactive CTL lines from a human donor) was measured by FACs and was used as a measure of IL-21 signaling. After resting CTLs for 48 hours (in order to reduce expression of PD-1), the cells were exposed (for 10 min) to (i) a fusion protein comprising an IL-21 R5E/R76A double mutein (open triangles in left graph), (ii) a fusion protein comprising an IL-21 R5Q/R76E double mutein (open triangles in middle graph), (iii) a fusion protein comprising an IL-21 R9E/R76A double mutein (open triangles in right graph), (iv) an IgG1 control (closed diamonds in each graph), (v) rhIL-21 (open squares in each graph), (vi) an anti-PD-1 mAb (dotted line in each graph), (vii) a combination of rhIL-21 and anti-PD-1 mAb (dashed line with closed circles in each graph), or (viii) a fusion protein comprising an IL-21 R76E single mutein (open diamonds in each graph). The FACs results are shown in FIGS. 12A-12C. The IL-21 activity of each fusion protein comprising an IL-21 double mutein is plotted against the activity achieved with (iv) an IgG1 control, (v) rhIL-21, (vi) anti-PD-1 mAb, (vii) a combination of rhIL-21 and anti-PD-1 mAb, and (viii) a fusion protein comprising an IL-21 R76E single mutein. This primary cell assay demonstrates that the double mutant fusions weakly stimulate IL-21-induced STAT3 signaling in resting CTLs (which express low levels of PD-1). IL-21 activity is most attenuated with the double mutein fusions (and is similar to that seen with the anti-PD-1 mAb and IgG1 control), with the single mutant fusion exhibiting moderate IL-21 activity attenuation, and the combination of rhIL-21 and anti-PD-1 mAb having similar activity to rhIL-21.

The effect of fusion proteins comprising an anti-PD-1 mAb and IL-21 double mutein homodimers on CTL-mediated cell cytotoxicity function upon chronic stimulation was also explored. CTLs were activated with CD3/CD28 and were exposed to (i) a fusion protein comprising IL-21 R5E/R76A double mutein, (ii) a fusion protein comprising an IL-21 R5Q/R76E double mutein, (iii) a fusion protein comprising an IL-21 R9E/R76A double mutein, (iv) an IgG4 control, (v) rhIL-21, (vi) anti-PD-1 mAb, or (vii) a combination of rhIL-21 and anti-PD-1 mAb. After seven days of stimulation the cells were co-cultured with a CMV peptide pulsed melanoma cancer cell line and cytotoxicity was measured. The results of this assay are shown in FIGS. 13A-13C.

As shown in FIGS. 13A-13C, the fusion proteins are able to sustain CTL function in a superior manner compared to anti-PD-1 mAb monotherapy. IL-21 muteins fusion proteins can sustain CTL mediated cell cytotoxicity function upon chronic stimulation. These results support the idea that IL-21 can sustain CTL function under conditions of chronic activation as is observed in cancer. Delivery of IL-21 to PD-1+ antigen specific T cells can selectively sustain the function of a population of T cells which drives therapeutic efficacy.

Example 8

This example demonstrates the in vivo pharmacokinetics with the double mutein constructs.

Fusion proteins comprising an anti-PD-1 mAb and either an IL-21 double mutein or an IL-21 single mutein were administered to naïve cynomolgus monkeys by intravenous bolus administration to characterize drug exposure. Table 9 shows the dose of each construct administered to the animals. The single mutein variant (IL-21 R76E) was tested in vivo as a homodimer and monomer to better understand how exposure can be further improved.

Serum concentration-time profiles for PD-1 mAb and PD-1:IL-21 fusions following intravenous bolus administration to naïve cynomolgus monkeys are shown in FIG. 14 with drug exposures observed the first week after administration listed in Table 9.

TABLE 9

| Animal Number: | Construct: | Dose (mg/kg) | $AUC_{0-168}$/Dose (hr * kg * μg/mL/mg) |
|---|---|---|---|
| | PD-1 mAb[a,b] | 8.25 | 2260 ± 150 |
| | PD-1:IL-21(R76A) homodimer[a,c] | 10 | 2.82 ± 0.93 |
| 803 & 804 | PD-1:IL-21(R5E/R76A) homodimer[d,e] | 5 | 39.1 ± 14.0 |
| 801 & 802 | PD-1:IL-21(R76E) homodimer[d,e] | 5 | 38.0 ± 19.6 |

TABLE 9-continued

| Animal Number: | Construct: | Dose (mg/kg) | $AUC_{0-168}$/Dose (hr * kg * μg/mL/mg) |
|---|---|---|---|
| 807 & 808 | PD-1:IL-21(R76E) monovalent[d,e] | 5 | 195 ± 4.8 |
| 805 & 806 | PD-1:IL-21(R5Q/R76E) homodimer[c,d] | 5 | 114 ± 14 |

[a]Nonhuman primate study
[b]Human Fc capture with human Fc detection
[c]Human IL-21 capture with human Fc detection
[d]Nonhuman primate study
[e]PD-1 capture with human IL21 detection As shown in Table 9, the monomeric R76E fusion protein exhibited superior exposure upon intravenous dosing as compared to the homodimer R76E fusion protein. Fusion proteins comprising the IL-21 double muteins (R5Q/R76E and R5E/R76A) observed greater exposures than parental single mutein homodimer fusion protein constructs (R76E and R76A, respectively) (FIG. 14; Table 9).

Pharmacodynamic (PD) parameters were also tested in vivo in cynomolgus monkeys. PD-1 expression was determined using non-competing antibody for PD-1 and this PD-1 sampling occurred at Day −5, Day 7, and Day 21. Animals were given a first dose of (i) a fusion protein comprising an anti-PD-1 mAb and a homodimer of an IL-21 R76E single mutein, (ii) a fusion protein comprising an anti-PD-1 mAb and a monomer of an IL-21 R76E single mutein, or (iii) a fusion protein comprising an anti-PD-1 mAb and an IL-21 R5Q/R76E double mutein on Day 1, and a second dose on Day 8. See FIG. 15A.

FIGS. 15B-15D show the fold change in PD-1-positive/CD4-positive cells (relative to Day −5) as measured on Day 7 (FIG. 15B), the fold change in PD-1-positive/CD8-positive cells (relative to Day −5) as measured on Day 7 (FIG. 15C), and the fold change in PD-1-positive/CD8-positive cells (relative to Day −5) as measured on Day 21 (FIG. 15D).

As shown in FIGS. 15B-15D, even a single dose of the fusion protein comprising an anti-PD-1 mAb and an IL-21 double mutant expands peripheral PD-1+/CD8+ T cells. This study demonstrated that double mutant fusion proteins are able to significantly expand PD-1+CD8 T cells in superior manner to single mutein parental variants.

PD biomarkers were also examined for differences and the data suggest that monomeric construct has lower target coverage and PD responses upon single dose administration but equivalent changes in PD and target coverage upon multi dose administration. These data suggest that PK properties of fusion proteins may be further improved with a monomeric format.

As shown in FIG. 16, receptor occupancy (RO) on CD8+ cells generally correlated with PD-1+CD8 T cell expansion for the double mutants (Animals 803, 805, 806). Single mutant homodimer constructs (Animals 801, 802) failed to expand PD-1+ CD8 T cells, likely due to their relatively poor pharmacokinetic properties. Notably, double mutein constructs, which have more desirable pharmacokinetic properties, expanded PD-1+ CD8 T cells and PD responses correlated with target coverage. The data suggest that double mutant fusion proteins can expand a relevant T cell population known to be involved in protective anti-tumor immunity.

FIG. 17 shows that PD-1 target coverage in CD8+ T cells upon repeat dosing is similar to what is observed for an anti-PD-1 mAb (anti-PD-1 mAb data not shown). Collectively, with respect to the double mutants, FIGS. 16 and 17 support the idea that modulation of the target population (PD-1+CD8 T cells) requires sufficient target coverage and that improved target coverage is correlated with improved pharmacodynamics responses.

Example 9

This example demonstrates the generation of a panel of fusion proteins comprising different anti-PD-1 mAbs fused to varying homodimeric IL-21 double muteins.

A panel of anti-PD-1 mAbs were generated and tested as described in Example 12 and lead mAbs were fused to certain IL-21 double muteins. Twelve fusion proteins comprising homodimeric IL-21 double muteins and anti-PD-1 mAbs were tested for IL-21 activity in both PD-1$^{-ve}$ and PD-1$^{+ve}$ Hut78 T-cells using the STAT3 phosphorylation assay, IL-21R binding and PD-1 binding using the ForteBio Octet assay, PD-1 activity using the PD-1 Jurkat reporter assay, and in vitro activity using the MLR (mixed lymphocyte reaction) assay. These experiments were carried out as essentially described in the previous examples.

A list of the twelve fusion proteins comprising an anti-PD-1 mAb and an IL-21 double mutein and their activities as measured in these assays are provided in Tables 10-12.

TABLE 10

IL-21 activity as measured by STAT3 phosphorylation assay

| PD-1 mAb | Amino Acid Subs of IL-21 Double mutein | Hut78 (n1) PD-1$^{+ve}$ EC50 (nM) | Hut78 (n2) PD-1$^{+ve}$ EC50 (nM) | Hut78 (n1) PD-1$^{-ve}$ EC50 (nM) | Hut78 (n2) PD-1$^{-ve}$ EC50 (nM) |
|---|---|---|---|---|---|
| A-1-003 (20A2.003) | (R5A, R76E) | 7.55 | 14.74 | >1000 | >1000 |
| A-1-003 (20A2.003) | (R5Q, R76E) | 3.37 | 16.9 | >1000 | >1000 |
| A-1-003 (20A2.003) | (R5E, R76A) | 5.70 | 25.07 | 618.28 | >1000 |
| A-1-003 (20A2.003) | (R9E, R76A) | 25.26 | 59.10 | >1000 | >1000 |

TABLE 10-continued

IL-21 activity as measured by STAT3 phosphorylation assay

| PD-1 mAb | Amino Acid Subs of IL-21 Double mutein | Hut78 (n1) PD-1$^{+ve}$ EC50 (nM) | Hut78 (n2) PD-1$^{+ve}$ EC50 (nM) | Hut78 (n1) PD-1$^{-ve}$ EC50 (nM) | Hut78 (n2) PD-1$^{-ve}$ EC50 (nM) |
|---|---|---|---|---|---|
| A-4-006 (20C1.006) | (R5A, R76E) | 7.40 | 15.33 | >1000 | >1000 |
| A-3-009 (20C1.009) | (R5Q, R76E) | 3.75 | 16.39 | >1000 | >1000 |
| A-3-009 (20C1.009) | (R5E, R76A) | 5.27 | 10.71 | 471.56 | >1000 |
| A-3-009 (20C1.009) | (R9E, R76A) | 19.44 | 56.43 | >1000 | >1000 |
| A-2-006 (22D4.006) | (R5A, R76E) | 6.90 | 8.04 | >1000 | >1000 |
| A-2-006 (22D4.006) | (R5Q, R76E) | 4.45 | 10.32 | >1000 | >1000 |
| A-2-006 (22D4.006) | (R5E, R76A) | 5.34 | 13.11 | 652.02 | 826.11 |
| A-2-006 (22D4.006) | (R9E, R76A) | 17.41 | 45.63 | >1000 | >1000 |
| rhIL-21(av) | — | 0.15 | 0.625 | 0.22 | 0.715 |
| Anti-PD-1 mAb (IgG4 isotype) | | — | — | — | — |
| Anti-PD-1 mAb (IgG1 isotype) | | — | — | — | — |
| 2$^{nd}$ Anti-PD-1 mAb (IgG4 isotype) | | — | — | — | — |

TABLE 11

IL-21R binding and PD-1 binding

| PD-1 mAb | Amino Acid Subs of IL-21 Double mutein | IL-21R Hu Kd (nM) | IL-21R Cy Kd (nM) | hPD-1 Kd (nM) | CyPD-1 Kd (nM) |
|---|---|---|---|---|---|
| A-1-003 (20A2.003) | (R5A, R76E) | >300 | >300 | 1.9 | 3.1 |
| A-1-003 (20A2.003) | (R5Q, R76E) | >300 | >300 | 2.4 | 2.6 |
| A-1-003 (20A2.003) | (R5E, R76A) | >300 | >300 | 4.4 | 4.7 |
| A-1-003 (20A2.003) | (R9E, R76A) | >300 | >300 | 1.5 | 3.3 |
| A-4-006 (20C1.006) | (R5A, R76E) | >300 | >300 | 0.8 | 1.6 |
| A-3-009 (20C1.009) | (R5Q, R76E) | >300 | >300 | 0.7 | 1.4 |
| A-3-009 (20C1.009) | (R5E, R76A) | >300 | >300 | 0.9 | 2.3 |
| A-3-009 (20C1.009) | (R9E, R76A) | >300 | >300 | 0.7 | 1.7 |
| A-2-006 (22D4.006) | (R5A, R76E) | >300 | >300 | 1.0 | 1.5 |
| A-2-006 (22D4.006) | (R5Q, R76E) | >300 | >300 | 1.2 | 1.4 |
| A-2-006 (22D4.006) | (R5E, R76A) | >300 | >300 | 1.2 | 1.0 |
| A-2-006 (22D4.006) | (R9E, R76A) | >300 | >300 | 1.3 | 1.3 |
| rhIL-21(av) | — | 0.038 | <0.010 | — | — |
| Anti-PD-1 mAb (IgG4 isotype) | | — | — | ~9 | ~9 |
| Anti-PD-1 mAb (IgG1 isotype) | | — | — | ~6 | ~4 |
| 2$^{nd}$ Anti-PD-1 mAb (IgG4 isotype) | | — | — | 2.4 | 1.0 |

TABLE 12

| PD-1 activity and MLR | | | | | |
|---|---|---|---|---|---|
| PD-1 mAb | Amino Acid Subs of IL-21 Double mutein | hPD-1 reporter N1 (nM) | hPD-1 reporter N1 (nM) | MLR N1 IL-2 (nM) | MLR N2 IL-2 (nM) |
| A-1-003 (20A2.003) | (R5A, R76E) | 0.748 | 0.622 | 3.438 | 2.198 |
| A-1-003 (20A2.003) | (R5Q, R76E) | 0.997 | 0.805 | 4.021 | 1.821 |
| A-1-003 (20A2.003) | (R5E, R76A) | 0.344 | 0.47 | 2.472 | 1.397 |
| A-1-003 (20A2.003) | (R9E, R76A) | 0.788 | 0.712 | 2.872 | 1.252 |
| A-4-006 (20C1.006) | (R5A, R76E) | — | — | — | — |
| A-3-009 (20C1.009) | (R5Q, R76E) | 0.472 | 0.738 | 1.04 | 1.186 |
| A-3-009 (20C1.009) | (R5E, R76A) | 0.445 | 0.46 | 0.345 | 0.77 |
| A-3-009 (20C1.009) | (R9E, R76A) | 0.669 | 0.409 | 1.191 | 0.68 |
| A-2-006 (22D4.006) | (R5A, R76E) | 0.331 | 0.269 | 0.469 | 0.88 |
| A-2-006 (22D4.006) | (R5Q, R76E) | 0.369 | 0.255 | 0.769 | 0.458 |
| A-2-006 (22D4.006) | (R5E, R76A) | 0.281 | 0.177 | 0.59 | 0.31 |
| A-2-006 (22D4.006) | (R9E, R76A) | 0.429 | 0.112 | 1.042 | 0.446 |
| rhIL-21(av) | — | — | — | — | — |
| Anti-PD-1 mAb (IgG4 isotype) | | 1.915 | 2.905 | 1.354 | 3.216 |
| Anti-PD-1 mAb (IgG1 isotype) | | — | — | — | — |
| 2$^{nd}$ Anti-PD-1 mAb (IgG4 isotype) | | 0.555 | 0.695 | 0.627 | 0.708 |

Most if not all candidates performed as well if not better than two anti-PD-1 mAbs. Several demonstrated potencies for PD-1 activity and in the MLR assay that were greater than or equal to the potency of the anti-PD-1 mAb.

Of the 12 candidates, two were selected as for further studies. One of the two had the IL-21 double mutein comprising R5Q/R76E mutations and the second had the IL-21 double mutein comprising R9E/R76A mutations. Different anti-PD-1 mAbs from the PD-1 mAb panel were used to make a fusion protein with one of the two IL-21 muteins. Ten anti-PD-1 mAbs were used in the R5Q/R76E fusion proteins, including the 20A2.003 (line with diamonds), 20C1.006 (line with open squares), 20C1.009 (line with triangles), and 22D4.006 (line with open circles) anti-PD-1 mAbs. Seven anti-PD-1 mAbs were used in the R9E/R76A fusion proteins, including the 20A2.003 (line with open triangles), 20C1.006 (line with open squares), 20C1.009 (line with open diamonds), and 22D4.006 (line with open circles) anti-PD-1 mAbs. The fusion proteins were tested for IL-21 activity using the STAT3 phosphorylation assay, as essentially described herein. FIGS. 18A-18B and 19A-19B show the activities in PD-1$^{-ve}$ and PD-1$^{+ve}$ HUT78 T cells, relative to rhIL-21 signals (hot pink line). As shown in these figures, the fusion proteins exhibited >1000× attenuation in PD-1$^{-v}$e HUT78 T cells but retained potency in PD-1$^{+ve}$ HUT78 T cells.

Example 10

This example demonstrates the generation of a panel of fusion proteins comprising different anti-PD-1 mAbs fused to varying monomeric and homodimeric IL-21 double muteins.

A panel of fusion proteins comprising an anti-PD-1 mAb and either a monomeric or homodimeric IL-21 double mutein was generated. A list of the fusion proteins comprising an anti-PD-1 mAb and an IL-21 double mutein are provided in Table 13.

TABLE 13

| PD-1 mAb | Amino Acid Subs of IL-21 Double mutein | IL-21 Mutein: Homodimer or Monomer | SEQ ID NO: of IL-21 mutein portion of fusion protein |
|---|---|---|---|
| A-2-006 V4 (22D4.006 V4) | R5E/R76A | Monomer | 238 |
| A-2-006 V4 (22D4.006 V4) | R9E/R76A | Monomer | 244 |
| A-2-006 V4 (22D4.006 V4) | R5A/R76E | Monomer | 237 |
| A-2-006 V4 (22D4.006 V4) | R5Q/R76E | Monomer | 241 |
| A-2-006 (22D4.006) | R5E/R76A | Homodimer | 238 |
| A-2-006 (22D4.006) | R9E/R76A | Homodimer | 244 |
| A-2-006 (22D4.006) | R5A/R76E | Homodimer | 237 |

TABLE 13-continued

| PD-1 mAb | Amino Acid Subs of IL-21 Double mutein | IL-21 Mutein: Homodimer or Monomer | SEQ ID NO: of IL-21 mutein portion of fusion protein |
|---|---|---|---|
| A-2-006 (22D4.006) | R5Q/R76E | Homodimer | 241 |
| A-2-006 V106 (22D4.006 V106) | R5Q/R76E | Monomer | 241 |
| A-2-006 V112 | R5Q/R76E | Monomer | 241 |
| A-2-006 V106 (22D4.006 V106) | R9E/R76A | Monomer | 244 |
| A-2-006 V112 ((22D4.006 V112) | R9E/R76A | Monomer | 244 |
| A-1-003 V4 (20A2.003 V4) | R5E/R76A | Monomer | 238 |
| A-1-003 V4 (20A2.003 V4) | R9E/R76A | Monomer | 244 |
| A-1-003 V4 (20A2.003 V4) | R5A/R76E | Monomer | 237 |
| A-1-003 V4 (20A2.003 V4) | R5Q/R76E | Monomer | 241 |
| A-1-003 (20A2.003) | R5E/R76A | Homodimer | 238 |
| A-1-003 (20A2.003) | R9E/R76A | Homodimer | 244 |
| A-1-003 (20A2.003) | R5A/R76E | Homodimer | 237 |
| A-1-003 (20A2.003) | R5Q/R76E | Homodimer | 241 |
| A-1-003 V106 (20A2.003 V106) | R5Q/R76E | Monomer | 241 |
| A-1-003 V112 (20A2.003 V112) | R5Q/R76E | Monomer | 241 |
| A-1-003 V106 (20A2.003 V106) | R9E/R76A | Monomer | 244 |
| A-1-003 V112 (20A2.003 V112) | R9E/R76A | Monomer | 244 |
| rhIL-21(av) | — | | |
| Anti-PD-1 mAb (IgG4 isotype) | | | |
| Anti-PD-1 mAb (IgG1 isotype) | | | |
| $2^{nd}$ Anti-PD-1 mAb (IgG4 isotype) | | | |

The fusion proteins were tested for IL-21 activity in both PD-$1^{-ve}$ and PD-$1^{+ve}$ Hut78 T-cells using the STAT3 phosphorylation assay, IL-21R binding and PD-1 binding using the ForteBio Octet assay, PD-1 activity using the PD-1 Jurkat reporter assay, and in vitro activity using the MLR assay. These experiments were carried out as essentially described in the previous examples. The activities as measured in these in vitro assays is shown FIGS. 20A-23D.

FIGS. 20A-20D represent the amount of pSTAT3 signaling observed with several anti-PD-1 mAb—IL-21 monomeric or homodimeric double mutein fusions. pSTAT3 signaling stimulated with rhIL-21 is shown in line with closed circles at the top of the graphs, while pSTAT3 signaling stimulated with an IgG1 control is shown in dashed line with open circles (bottom of graphs) and with an IgG2 control is shown in line with X's (bottom of graphs). Anti-PD-1 mAb-(present as mAb; i.e., not as a fusion) stimulated pSTAT3 signaling is shown in dotted line with closed squares (bottom of graphs). pSTAT3 signaling stimulated with control anti-PD-1 mAbs is shown in dashed line with open squares and dotted line with open diamonds (bottom of graphs), while the remaining lines represent the pSTAT3 signaling achieved upon stimulation with anti-PD-1 mAb—IL-21 monomeric or dimeric double mutein fusions (with various charge pair mutations) wherein the double mutants are R5E/R76A; R9E/R76A; R5A/R76E or R5Q/R76E. As shown in this set of figures, rhIL-21 demonstrates activity in both PD-$1^{-ve}$ and PD-$1^{+ve}$ cells. In contrast, monomeric and homodimeric double mutein fusions are able to demonstrate pSTAT3 (IL-21-based) activity only in PD-$1^{+ve}$ cells and not in PD-$1^{-ve}$ cells. Thus, monomeric fusions with IL-21 double mutants exhibit similar levels of IL-21 activity attenuation in PD-1-ve cells and IL-21 activity rescue in PD-$1^{+}$ cells as their counterpart dimeric fusions.

Figure 21C:
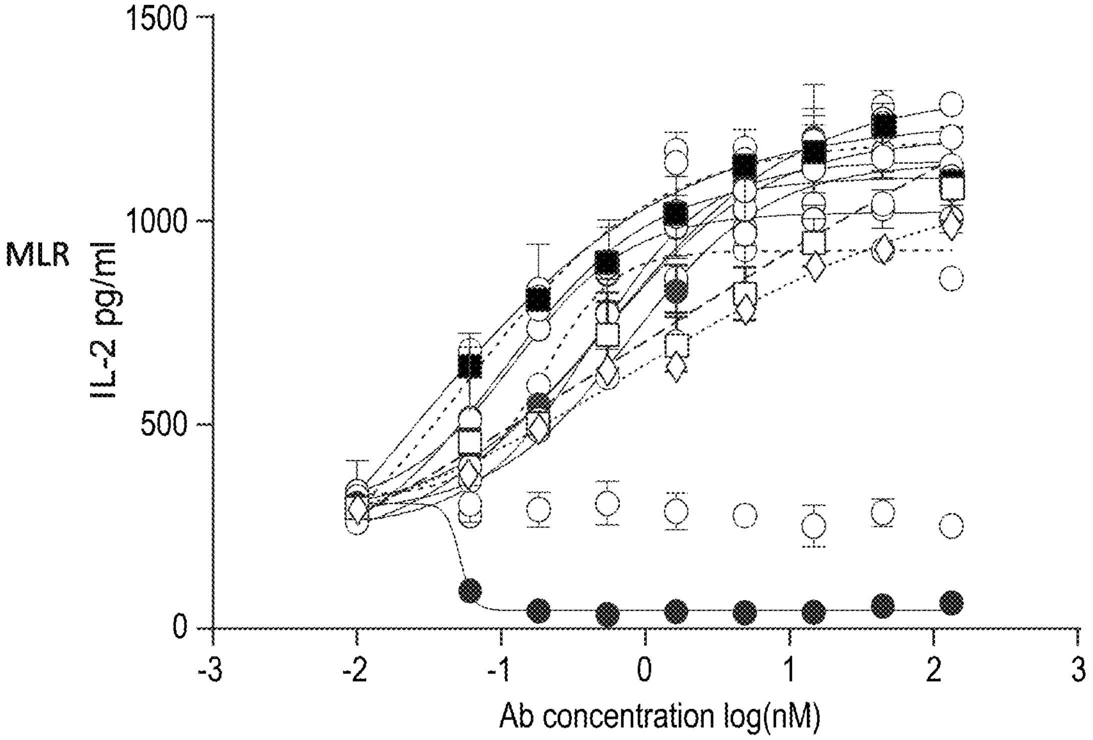
Figure 21D:
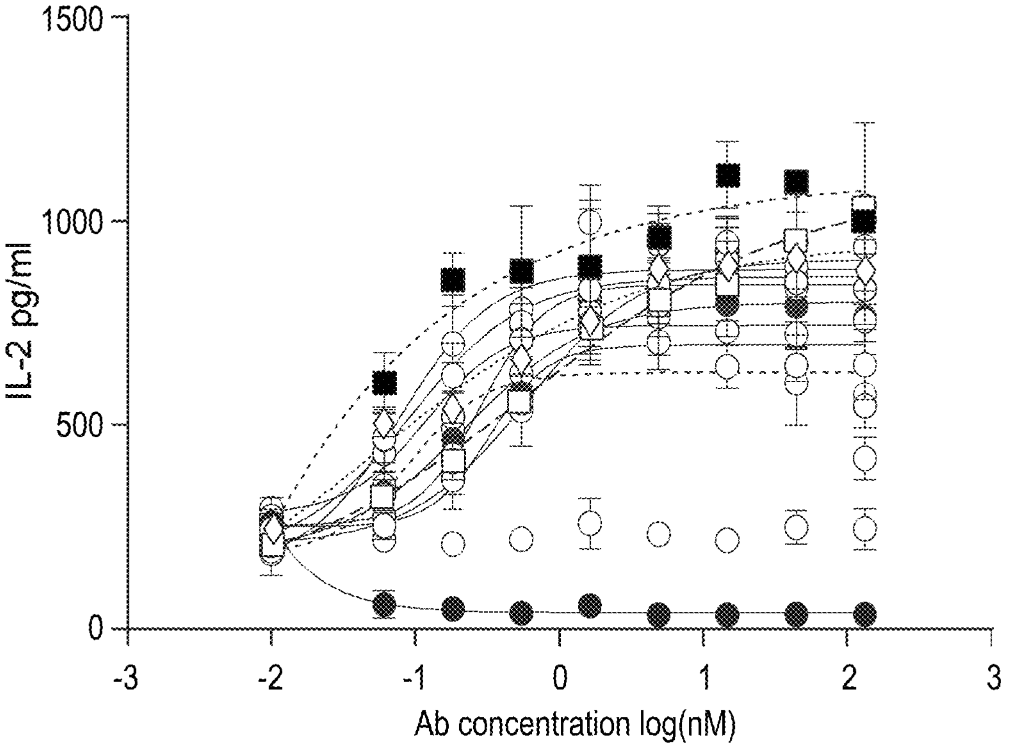

The fusion proteins evaluated in FIGS. 20A-20D were tested in a PD-1 reporter gene assay (RGA; FIGS. 21A and 21B) and an MLR assay (FIGS. 21C and 21D). The results shown in FIGS. 21A-21D demonstrate that anti-PD-1 mAb—IL-21 monomeric and dimeric double mutein fusions are able to induce PD-1 activity.

The results of pSTAT3 assays testing the same anti-PD-1 mAb—IL-21 monomeric and dimeric double mutein fusions constructs as those in FIGS. 20A-20D, except with a different anti-PD-1 mAb, are shown in FIGS. 22A-22D. The results in FIGS. 22A-22D are similar to those seen in FIGS. 20A-20D.

The results of PD-1 reporter gene assays and MLR assays testing the same anti-PD-1 mAb-IL-21 monomeric and dimeric double mutein fusions constructs as those in FIGS. 21A-21D, except with a different anti-PD-1 mAb, are shown in FIGS. 23A-23D.

These data demonstrate that a fusion protein comprising an IL-21 double mutein may not require a homodimer configuration for partial attenuation. The following double muteins (fused as monomers or homodimers) to an anti-PD-1 mAb (Table 14) were selected for further evaluation.

TABLE 14

| | IL-21 mutein | Format |
|---|---|---|
| A-2-017 (22D4.017) | R5Q:R76E | homodimer |
| A-2-017 (22D4.017) | R5Q:R76E | V1 monomer |
| A-2-017 (22D4.017) | R9E:R76A | Homodimer |
| A-2-017 (22D4.017) | R9E:R76A | V1 monomer |

The cell based data suggest that these muteins when fused to a PD-1 antibody can selectively target T cells (demonstrated using T cell lines) expressing PD-1 receptor. These bifunctional PD-1×IL-21 molecules have unique properties acquired from each arm of the fusion molecule (anti PD-1 mAb and IL-21 mutein).

Example 11

The following materials and methods were used in the examples.

Generation of Anti-PD-1 Ab—IL-21 Mutein Fusions

Recombinant anti-PD-1 Ab—IL-21 mutein sequences were cloned into pTT5 for transient expression in HEK293-6E or a vector containing an antibiotic selection cassette for stable expression in CHO-K1 cells. Expression productions were performed for 5-7 days at 36° C. and the supernatant was harvested for purification. All protein lots were purified by Protein A affinity chromatography (Mab Select SuRe)

followed by cation exchange (SP Sepharose HP) and buffer exchange (UF/DF) into A5.2Su buffer. All lots were >95% main peak by size exclusion chromatography with endotoxin <0.2 EU/mg (Endosafe LAL, Charles River).

Jurkat PD-1 Reporter Gene Assays

GloResponse Jurkat NFAT-luc2/PD-1 stable effector cells (Promega, #CS187102) and the CHO PD-L1 stable cell line (Promega, #CS178103) were co-cultured at a ratio of 1.25:1 in the presence of serially diluted antibodies in triplicate for 6 hours at 37° C., 5% $CO^2$. Luminescence was measured using Bio-Glo Luciferase Assay System (Promega, #G7940).

STAT3 Phosphorylation Assays pSTAT3 AlphaScreen.

HuT 78 parental and HuT 78 PD-1 stable cell lines were then seeded onto separate plates at 40,000 cells per well in the presence of serially diluted antibodies in triplicate for 40 minutes at 37° C., 5% $CO_2$. Pstat3 Tyr705 levels were measured using AlphaLisa Surefire Ultra Pstat3 (Tyr705) Assay Kit (Perkin Elmer, #ALSU-PST3-A10K).

HTRFphospho-STAT3 Assay.

Cells were serum starved overnight in RPMI 1860 media supplemented with 1% L-glutamine (HyClone Cat #SH30034.01). Cells were then resuspended in phenol red-free Hanks' Balanced Salt Solution without calcium and magnesium (HBSS; ThermoFisher Cat #14175095) at 2.5×$10^6$ cells/mL and 8 uL/well was plated onto 384-well small volume white plate (Perkin Elmer Cat #6008289). Cells were then stimulated with 4 uL/well of IL-21 mutein molecules diluted in HBSS at 37° C. for 40 minutes. STAT3 phosphorylation was detected using HTRF® phosphor-STAT3 (Tyr705) assay kit accordingly to manufacturer's recommendation (Cisbio Cat #64NT3PEH). FRET signal from the assay was detected using EnVision Multilable Plate Reader (Perkin Elmer). Data were analyzed by first determining the HTRF ratio as recommended by Cisbio and then calculating fold over background values using data from unstimulated cells. For each experiment, dosing curves were plotted and potency of a given molecule is represented as the concentration at which a defined fold over background value was observed.

Mixed Lymphocyte Reaction (MLR)

Mismatched donor pair leukopaks were obtained from AllCells Inc. Donor's T cells were isolated using Pan T-cell Isolation Kit (Milteny Biotec, #130-096-535) and a mismatched donor's monocytes were isolated using Pan Monocyte Isolation Kit (Miltenyi Biotec, #130-096-537). Monocytes were further matured for 10 days using CellXVivo Human Monocyte-Derived Dendritic Cell Differentiation Kit (R&D Systems, #CDK004). Pan-T cells were co-cultured with matured monocytes at a ratio of 10:1 in the presence of serially diluted antibodies in triplicate for 72 hours at 37° C., 5% $CO^2$. Supernatant IL-2 levels were measured by ELISA (Mesoscale Discoveries, #K151QQD-4).

IL-21R and PD-1 Binding Assays

Human and Cynomolgus Monkey IL-21R Binding Affinity:

Both monovalent IL-21R-FLAG-His and bivalent IL-21R-Fc recombinant reagents were tested but produced very similar results (within ~2-3 fold). The recombinant soluble IL-21R reagents were minimally biotinylated and captured on Streptavidin SAX tips to a 2.0 nm loading level. The tips were then incubated in wells where the PD-1 antibody-IL-21 samples were 3-fold serially diluted. For wildtype IL-21 fusions, the top sample concentration was 10 nM, while for IL-21 mutein fusions the top sample concentration was 300 nM. An association time of 20 minutes and a dissociation time of 1.5 hour was used to maximize curvature in the binding graphs in order to get accurate kinetic fits.

Human and Cynomolgus Monkey PD-1 Binding Affinity:

Human and cynomolgus monkey PD-1 binding affinity were tested by first capturing the PD-1 antibody-IL-21 samples through EDC-NHS amine coupling to AR2G tips; sample loading was typically at pH 6 for 2000 seconds followed by quenching with 1 M Enthanolamine in order to immobilize at least a 2 nm level. Once samples were immobilized, the tips were then incubated in wells containing a 3-fold serial dilution of soluble, recombinant receptors human PD-1(1-170)-FLAG-His or cynomolgus monkey PD-1(1-167)-FLAG-His. In both cases, top PD-1 concentration was 30 nM. Association for 300 seconds and dissociation for 500 seconds were used since they produced enough curvature for accurate kinetic fits.

The above human/cynomolgus monkey IL-21R and human/cynomolgus monkey PD-1 binding affinities were quantitated with ForteBio Octet HTX and RED384 instruments. In all cases, standard Octet sample buffer was used for sample dilution and for all binding baseline, association and dissociation steps (10 mM Tris, pH 7.5, 150 mM NaCl, 1 mM CaCl2, 0.10 mg·ml BSA, 0.13% (v/v) Triton X-100).

All ForteBio raw data was processed in the following manner using the standard instrument data analysis software (v9 and v10): (a) two reference tip curves which had immobilized target but no interaction (i.e. buffer only) were averaged and subtracted from the remaining sample tips curves in the same column; (b) the association and dissociation curves were isolated and aligned to the Y axis; (c) the association and dissociation interstep were aligned; (d) Savitzky-Golay filtering was implemented to reduce the signal noise and (e) the resulting set of association and dissociation curves for each sample-target interaction were globally fit with a single 1:1 binding model to determine the measured values of the association rate constant $k_a$ and the dissociation rates constants $k_d$; the equilibrium dissociation constant $K_D$ was calculated as a ration of the dissociation and association rates constants ($=k_d/k_a$).

Example 12

This example describes the generation of anti-PD-1 mAbs for use in the fusion proteins comprising IL-21 muteins.

Generation of Anti-PD-1 Immune Responses

Mouse Strains

Fully human antibodies to human PD-1 were generated by immunizing XENOMOUSE® transgenic mice (U.S. Pat. Nos. 6,114,598; 6,162,963; 6,833,268; 7,049,426; 7,064,244, which are incorporated herein by reference in their entirety; Green et al., 1994, *Nature Genetics* 7:13-21; Mendez et al., 1997, *Nature Genetics* 15:146-156; Green and Jakobovits, 1998, *J Ex. Med,* 188:483-495; Kellerman and Green, *Current Opinion in Biotechnology* 13, 593-597, 2002). Animals from the XMG4-K and XMG4-KL XENOMOUSE® strains were used for these immunizations.

Immunizations

A cell-based route of immunization was used to generate anti-human PD-1 immune responses. CHO-S cells were transiently transfected with either human PD-1 fused through a Gly-Ser-Ser linker to an E3K T cell epitope tag or cynomolgus PD-1 as a source of immunogen. Animals were immunized with either of these transiently transfected CHO cells mixed Alum with CpG-ODN, 13 times over 8 weeks using TIP (base of tail and intraperitoneal) injections. The initial boost was comprised of 4 million cells expressing human PD-1 while subsequent boosts contained 2 million cells expressing human or cynomolgus PD-1. A total of 9 immunizations were performed with human PD-1 (1-6, 8, 10 and 13) and the remaining 4 immunizations were performed with cynomolgus PD-1. Animals were bled after the $10^{th}$ boost to assess PD-1-specific titers.

PD-1-specific serum titers were monitored by live-cell FACS analysis on an Accuri flow cytometer. Briefly, HEK293 cells were mock-transfected or transiently transfected with either human or cynomolgus PD-1. Scra from immunized animals was diluted 100-fold and incubated on the transfected cells for 1 hour on ice. The cells were then washed to remove unbound antibodies and a secondary anti-human Fc specific antibody labeled with Cy5 was incubated on the cells for an additional 15 minutes at 4 degrees. The cells were washed once to remove unbound secondary antibody and fluorescent signal on the cells was quantitated by FACS. Animals with the highest antigen-specific serum native titers directed against human and cynomolgus PD-1 were used for hybridoma generation (Kohler and Milstein, 1975).

| Immunogen | Adjuvant | Strain | Harvest |
|---|---|---|---|
| Human PD-1 or cynomolgus PD-1 transiently transfected into CHO-S | Alum + CpG ODN | G4K<br>G4KL | 4 mice<br>4 mice |

Preparation of Monoclonal Antibodies

Hybridoma Generation

Animals exhibiting suitable serum titers were identified and lymphocytes were obtained from spleen and/or draining lymph nodes. Pooled lymphocytes (from each harvest) were dissociated from lymphoid tissue by grinding in a suitable medium (for example, Dulbecco's Modified Eagle Medium (DMEM); Invitrogen, Carlsbad, Calif.). B cells were selected and/or expanded using standard methods, and fused with a suitable fusion partner using techniques that were known in the art.

Membrane Prep Generation:

20 million 293T cells were transfected with pTT5-mini4: huPD-i::GSS:E3K using 293fectinTM Transfection Reagent (Thermo Fisher, Cat: 12347019). 24 hours after transfection, the 293T cells were biotinylated by incubating them in pH8.6 PBS containing EZ-LinkTM NHS-LC-LC-Biotin (Thermo Fisher Cat: 21343) at 400 μg/mL for 30 minutes. The cells were then washed in neutral pH PBS and then resuspended in hypotonic buffer containing EDTA free protease inhibitor and 10% triton X100. Cells were broken up by repeatedly pumping them through a syringe with 26 gauge needle. Cell fragments were pelleted by centrifuging at 12000G for 20 minutes. The supernatant containing membrane particles was then collected and washed 3 times with PBS in Amicon Ultracel 100k centrifugal column (Millipore, Cat UFC810024) to remove detergent. The membrane preps were then tested on tracking hits (positive control hybridoma cells with specificity to PD-1) to check for IgG correlated membrane prep binding. Membrane prep were then aliquoted and frozen down at −20 degrees Celsius until use.

Antigen Specific Staining of Hybridoma Cells:

Hybridoma cells were removed from the flask and washed in sterile FACS buffer (2% FBS PBS). Cells were then mixed with PD-1 membrane prep (diluted 1:10 in FACS buffer, 1 mL reaction volume, e.g. 100 μL membrane prep in 900 μL FACS buffer) and incubated at 4 degrees Celsius for 1 hour. Cells were washed again in FACS buffer and stained with 1 mL of detection cocktail containing 5 g/mL of Alexa Fluor 488 conjugated F(ab')2 fragment goat anti-human IgG Fc (Jackson, Cat: 109-546-098) and Alexa Fluor 647 conjugated streptavidin (Jackson, Cat: 016-600-084) then incubated at 4 degrees Celsius for 30 minutes in the dark. Cells were washed again in FACS buffer, resuspended in media and then put through a 40 micron cell strainer to remove aggregated cells. Antigen specific cells were sorted using BD FACSAria 3 by gating on population exhibiting both Alexa Fluor 488 and Alexa Fluor 647 fluorescence (IgG+ and antigen binding cells).

The sorted cells were allowed to culture for a few days in hybridoma media. A small sample of the enriched cells were taken out and tested for binding to PD-1 membrane prep using same staining conditions as mentioned above. After confirming the successful enrichment of PD-1 specific cells, the hybridomas were then single cell sorted into 384-well microtiter plates using BD FACSAria 3. After 2 weeks of culture, supernatants from the microtiter plates were collected and screened for PD-1 binding.

Initial Selection of PD-1 Specific Binding Antibodies

Exhausted hybridoma supernatants were tested for binding to human PD-1 transiently expressed on HEK293 cells by Cell Insight. Briefly, HEK293 cells were transiently transfected with a mammalian expression construct encoding PD-1 using 293Fectin. The following day, 15 μL of exhausted hybridoma media was added to each well of a 384 well FMAT plate. Then, the transfected HEK293 cells (0.27 million/mL), the nuclear stain Hoechst 33342 (7.5 μg/mL) and a secondary detection antibody (0.75 g/mL—Goat anti Human IgG (H+L) Alexa 488 (Jackson ImmunoResearch)) were mixed and 30 μL of this mixture was added to each well of a 384 well FMAT plate. After −3 hours, the supernatant was aspirated using an AquaMax plate reader and 30 μL of FACS buffer was added to each well using a multidrop instrument. The plates were placed on a Big Bear Plate shaker to evenly distribute the cells in the well and then read on the Cell Insight platform using the Cell Health Bio-App. This analysis led to the identification of 383 antigen-specific antibodies from this harvest.

Jurkat Human PD-1/NFAT-Luciferase Reporter Assay

Jurkat cells stably expressing human PD-1 and NFAT-luciferase reporter (Promega) were cultured in RPMI 1640 medium (Sigma) supplemented with 10% fetal bovine serum (Sigma), 2 mM L-glutamine (Sigma), 10 mM HEPES (Hyclone, GE Healthcare Life Sciences), 500 μg/mL geneticin (Gibco Life Technologies), 100 μg/mL hygromycin B (Invitrogen) at 37° C./5% $CO_2$. Jurkat cells stably expressing cynomolgus PD-1 and NFAT-luciferase reporter (Promega) were cultured in RPMI 1640 medium (Sigma) supplemented with 10% fetal bovine serum (Sigma), 2 mM L-glutamine (Sigma), 10 mM HEPES (Hyclone, GE Healthcare Life Sciences), 200 μg/mL hygromycin B (Invitrogen), 300 μg/mL zeocin (Invitrogen) at 37° C./5% $CO_2$. Chinese Hamster Ovary (CHO) clonal cell line 99 stably expressing human PD-L1 (Promega) were cultured in Nutrient Mixture F12 HAM (Sigma), 10% fetal bovine serum, 10 mM HEPES, 250 μg/mL geneticin, 200 μg/mL hygromycin B at 37° C./5% $CO_2$. On the day of experiment, the Jurkat NFAT-luciferase/PD-1 cells and the CHO Clone 99 PD-L1 cells (detached with trypsin) were centrifuged at 200×g for 5 minutes, and resuspended in assay medium (RPMI 1640 medium, 2% fetal bovine serum, 15 mM HEPES). Test molecules were diluted and titrated using the assay buffer in 384-well black/clear bottom assay plates (Corning). The prepared cells were seeded at 40,000 cells/well total by first mixing the prepared cells at a 1:1 ratio, and then adding the cell mixture to the assay plates. The plates were incubated for 18 to 24 hours at 37° C./5% $CO_2$. The amount of luciferase produced was measured by Bio-Glo Luciferase Assay System reagent (Promega), after which the plates were incubated for 20 minutes at room temperature, and luminescence detected with EnVision plate reader (PerkinElmer). For single point assay, ESN samples were first quantitated, normalized and tested at 0.5 μg/mL. For potency determination, ESN samples or purified antibodies were serially titrated 3-fold in assay media and used to treat human or cynomolgus PD-1 reporter cells. The number of antibodies showing desired activity during single concentration screening and potency ranking are show in Table 15.

TABLE 15

| Single point | Potency ranking | Unique sequences |
|---|---|---|
| 86/383 | 12/86 | 4/12 |

The activity of purified anti-PD-1 antibodies (n=1 for human PD-1 assay shown) is shown in FIG. 24 and the potency of purified anti-PD-1 antibodies in human and cynomolgus PD-1 reporter assays are listed in Table 16.

TABLE 16

| | Potency (nM) | | | |
|---|---|---|---|---|
| Ab ID | Human PD-1 n = 1 | Human PD-1 n = 2 | Cynomolgus PD-1 n = 1 | Cynomolgus PD-1 n = 2 |
| A-1 (20A2) | 3.10 | 1.27 | 2.34 | ND |
| A-3 (20C1) | 5.51 | 1.88 | 5.17 | 4.16 |
| A-2 (22D4) | 2.43 | 0.71 | 2.72 | 2.89 |

Molecular Rescue and Sequencing of PD-1 Antagonist Antibodies

RNA (total or mRNA) was purified from wells containing the PD-1 antagonist antibody-producing hybridoma cells using a Qiagen RNeasy mini or the Invitrogen mRNA catcher plus kit. Purified RNA was used to amplify the antibody heavy and light chain variable region (V) genes using cDNA synthesis via reverse transcription, followed by a polymerase chain reaction (RT-PCR). The fully human antibody gamma heavy chain was obtained using the Qiagen One Step Reverse Transcriptase PCR kit (Qiagen). This method was used to generate the first strand cDNA from the RNA template and then to amplify the variable region of the gamma heavy chain using multiplex PCR. The 5' gamma chain-specific primer annealed to the signal sequence of the antibody heavy chain, while the 3' primer annealed to a region of the gamma constant domain. The fully human kappa light chain was obtained using the Qiagen One Step Reverse Transcriptase PCR kit (Qiagen). This method was used to generate the first strand cDNA from the RNA template and then to amplify the variable region of the kappa light chain using multiplex PCR. The 5' kappa light chain-specific primer annealed to the signal sequence of the antibody light chain while the 3' primer annealed to a region of the kappa constant domain. The fully human lambda light chain was obtained using the Qiagen One Step Reverse Transcriptase PCR kit (Qiagen). This method was used to generate the first strand cDNA from the RNA template and then to amplify the variable region of the lambda light chain using multiplex PCR. The 5' lambda light chain-specific primer annealed to the signal sequence of light chain while the 3' primer annealed to a region of the lambda constant domain.

The amplified cDNA was purified enzymatically using exonuclease I and alkaline phosphatase and the purified PCR product was sequenced directly. Amino acid sequences were deduced from the corresponding nucleic acid sequences bioinformatically. Two additional, independent RT-PCR amplification and sequencing cycles were completed for each hybridoma sample in order to confirm that any mutations observed were not a consequence of the PCR. The derived amino acid sequences were then analyzed to determine the germline sequence origin of the antibodies and to identify deviations from the germline sequence. A comparison of each of the heavy and light chain sequences to their original germline sequences are indicated. The amino acid sequences corresponding to complementary determining regions (CDRs) of the sequenced antibodies were aligned and these alignments were used to group the clones by similarity.

Primary Cell Binding Assays

The binding of hybridoma supernatants to PD-1 expressed by primary human and cynomolgus monkey cells were tested by flow cytometry. For human primary cell binding assay, purified human T cells (Biological Specialty Corp.) were thawed and suspended at a concentration of $2.5\times10^6$ cells/mL. T cells were stimulated with 5 ug/mL of anti-human CD3 clone OKT3 (eBioscience) and 1 μg/mL of anti-human CD28 (BD Pharmingen) for 72 hours at 37° C./5% $CO_2$ in a plate that had been pre-coated with 5 g/mL anti mouse IgG Fc (Pierce). After 72 hours, cells were removed, washed and suspended at a concentration of $0.5\times10^6$ cells/mL with 10 ng/mL of IL-2 (Pepro Tech). Cells were then incubated for another 48 hours at 37° C./5% $CO_2$. For cynomolgus primary cell binding assay, cynomolgus PBMCs (SNBL) were thawed and suspended in a concentration between $4\times10^6$ and $5\times10^6$ cells/mL. PBMCs were stimulated with 1 μg/mL of anti-human CD3 clone SP34 (BD Pharmingen) and 1 μg/mL of anti-human CD28 (BD Pharmingen) for 72 hours at 37° C./5% $CO_2$ in a plate that had been pre-coated with 5 μg/mL anti-mouse IgG Fc (Pierce). After 72 hours, cells were removed, washed and suspended at a concentration of $0.5\times10^6$ cells/mL with 20 ng/mL of IL-2 (Pepro Tech). Cells were then incubated for another 48 hours at 37° C./5% $CO_2$. After the final incubation, cells were prepared for flow cytometry by incubation with normalized hybridoma supernatants, positive control antibodies and isotype control antibodies at 1 μg/mL final concentration. Alexa Fluor 647 AffiniPure F(ab')$_2$ Fragment Goat Anti-Human IgG (H+L) (Jackson ImmunoReserach) at 5 μg/mL was used for secondary detection and 8.25 nM YoPro1 (Invitrogen) was used for a live/dead cell stain. Cells were then ran on BD FACSCanto II flow cytometer to detect anti-PD-1 antibody binding. Results are expressed as FACS geomean of PD-1 expressing cells and data are shown in Table 17.

TABLE 17

| Antibody ID | Primary Cyno (FACS Geomean) | Primary Human (FACS Geomean) |
|---|---|---|
| A-1 (20A2) | 194 | 326 |
| A-3 (20C1) | 187 | 312 |
| A-2 (22D4) | 188 | 329 |

Receptor—Ligand Competition Assay

PD-1-binding hybridoma supernatants were then tested for their ability to block PD-1 from binding ligand. Competitive binding assays were performed on the antigen-specific hybridoma supernatant samples using FACS on HEK293 cells transiently expressing human PD-1 as follows. HEK293 cells expressing human PD-1 were mixed with the antibody sample (hybridoma supernatants specific for PD-1) and incubated for 1 hour at 4° C., and then washed twice. Cells with bound sample were then incubated with huPD-L1-Fc-Alexa647 or huPD-L2-Fc-Alexa 647 (R&D systems, Minneapolis, Minn.) for 45 minutes at 4° C. The 7-AAD cell viability stain was then added and the cells incubated for a further 15 minutes at 4° C., washed twice and resuspended in FACS buffer. Samples were analyzed using a BD Accuri™ Flow Cytometer and an Intellicyt HyperCyt autoSampler. The data in the Table 18 reflects that percent inhibition of human PD-L1 of PD-L2 binding to human PD-1 at 1 ug/mL.

TABLE 18

Competition analysis of anti-PD-1 antibodies with PD-L1 or PD-L2 binding to PD-1

| Antibody ID | R-L PD-L1 (% inhibition) | R-L PD-L2 (% inhibition) |
|---|---|---|
| A-1 (20A2) | 72% | 71% |
| A-3 (20C1) | 64% | 65% |
| A-2 (22D4) | 71% | 72% |

Affinity Gap Analysis

Kinetic measurements of several of the antibodies were evaluated using the KinExA® method.

This method involves solution-based determination of formal affinity measurements at equilibrium.

Poly(methyl methacrylate) or PMMA beads were coated with biotinylated human PD-1 by first adsorption coating the PMMA beads with biotinylated BSA, Neutravidin and then with biotinylated PD-1.

KinExA experiments were performed using an automated flow immunoassay system, KinExA 3200, in which beads coupled with PD-1 served as the solid phase. Briefly, a constant amount of anti-hPD-1 mAbs (3 nM or 1 nM or 100 pM) was incubated with titrating concentrations of h-PD-1 or cy-PD-1 starting at 100 nM in sample buffer (PBS with 0.1% BSA to reduce nonspecific binding). Antigen/antibody complexes were incubated at RT for 48 hrs to 72 hrs to allow equilibrium to be reached. The mixture was drawn through the PD-1-coupled beads to accumulate unbound antibody. The volumes and flow rates of the mixture were varied-depending upon the specific signal obtained in each experiment.

The captured mAb was detected using solutions containing a secondary Ab Goat anti-Hu IgG (H+L)-Alexa647 antibody in sample buffer. The bound signals were converted into relative values as a proportion of control in the absence of hu- or cy-PD-1. Two replicates of each sample were measured for all equilibrium experiments. The equilibrium dissociation constant (Kd) was obtained from nonlinear regression analysis of the data using a one-site homogeneous binding model contained within the KinExA n-curve analysis software. The software calculates the Kd and determines the 95% confidence interval by fitting the data points to a theoretical Kd curve. The 95% confidence interval is given as Kd low and Kd

TABLE 19

Affinity of purified anti-PD-1 antibodies for recombinant human and cynomolgus PD-1

| | Affinity for human PD-1 | | | Affinity for Cyno PD-1 | | | |
|---|---|---|---|---|---|---|---|
| mAb ID | KD (pM) | 95% CI (pM) | % active mAb | KD (pM) | 95% CI (pM) | % active mAb | Hu:Cy Fold difference |
| A-1 (20A2) | 17 | 13-23 | 25 | 15 | 12-19 | 21 | 0.9 |
| A-3 (20C1) | 16 | 13-21 | 17 | 60 | 52-68 | 18 | 3.8 |
| A-2 (22D4) | 4.5 | 3.6-5.5 | 27 | 3.7 | 2.7-4.8 | 23 | 0.8 |

Kd calculated by taking PD-1 concentration as known concentration and letting software to calculate Kd and the mAb concentration.

Activity Confirmation of Purified Antibodies in MLR Assay

Human immature monocyte-derived dendritic cells (Astarte) were thawed and differentiated into mature dendritic cells through culture in IL-4, GM-CSF and TNF-α for 72 hours using CellXVivo Human Monocyte-Derived Dendritic Cell Differentiation Kit (R&D Systems #CDK004). The non-adherent and loosely adherent cells were removed, combined and centrifuged to pellet the cells. After the media was removed, the cells were resuspended in X-Vivo-15 media at 400×10^3 cells/mL and dendritic cells were added to each cell of a 96-well plate (20 k cells in 50 μL). Human T cells (Astarte) were quickly thawed and washed in X-Vivo-15 media. The cells were re-suspended at 2×10^6 cells/mL and 100 μL was added to each well (200 k cells/100 μL). Antibodies were diluted and added to each well in a 50 μL total volume. The mixture was incubated for three days at 37 degrees. At this time, the cells were spun down and 175 μL were used to measure IL2 production as a measure of T cell proliferation using the IL-2 V-Plex Kit (MSD) as per manufacturers recommendations.

TABLE 20

| Antibody ID | MLR IC50 (nM) | MLR IC50 (nM) |
|---|---|---|
| A-1 (20A2) | 0.73 | 0.80 |
| A-3 (20C1) | 0.97 | 1.65 |
| A-2 (22D4) | 0.65 | 0.58 |

Example 13

When possible, the A-1 (20A2), A-3 (20C1), and A-2 (22D4) anti-PD-1 variable domain sequences were engineered to remove motifs having a risk of sidechain degradation. Such amino acid motifs include: (1) CDR 'NG' and 'NT' sequences prone to asparagine deamidation, (2) CDR 'DG,' 'DH', 'DS,' and 'DT' sequences prone to aspartic acid isomerization, (3) and CDR3 tryptophans prone to oxidation. Typically, substitution identities were derived from germline sequences or from sequence-related PD-1-binding mAbs. For cases in which the bioinformatics or structural analyses did not provide a clear substitution identity, residue types chemically similar to the parent residue were selected.

Variable domain sequence motifs violating multiple sequence alignment-based pair-wise residue covariance trends were also removed. Remediation of pair-wise covariance violators through substitution with germline or germline-related residue types can lead to better manufacturability due to increased mAb expression levels and biophysical stabilities. See, Kannan, G. Method of Correlated Mutational Analysis to Improve Therapeutic Antibodies. US Patent Application PCT/US2012/028596 filed Mar. 9, 2012. Substitution identities for covariance violators were selected using approached similar to that used to remediate degradation sites, as discussed above.

Engineering of 20A2 led to 20A2.003. Engineering of 20C1 led to 20C1.006 and 20C1.009. Engineering of 22D4 led to 22D4.006 and 22D4.017.

Example 14

The in vivo activity of the fusion protein comprising the anti-PD-1 antibody 22D4.017 fused to a monomer IL-21 double mutein comprising R9E and R76A mutations ("[22D4.017]-[R9E:R76A](monomer)") was evaluated in naïve non-human cynomolgus monkeys. A first group of monkeys received the anti-PD-1 antibody 22D4.017 alone (not fused to an IL-21 mutein), and a second group of monkeys received the fusion protein [22D4.017]-[R9E:R76A] (monomer). Pharmacodynamic (PD) parameters were monitored using FACS in peripheral blood and included immune cell dynamics and STAT3 transcription factor phosphorylation (pSTAT3) in lymphocytes. Serum cytokines and perforin were also examined by Millipore Milliplex® multi-analyte profiling (MAP) multiplex assay. Pre-dose analysis of peripheral blood parameters was conducted to allow normalization of datasets to baseline. Dosing began on Day 1. Blood and serum were drawn at predetermined fixed time points.

Despite the activation of Ki67 [FIGS. 25A and 25B] and STAT3 [FIGS. 25C and 25D] in T cells, no significant increase in the bulk T cell population was observed in the groups administered either the 22D4.017 antibody or the [22D4.017]-[R9E:R76A] (monomer) fusion protein [FIGS. 25A and 25B], suggesting that both of these treatments were insufficient by themselves to induce expansion of the bulk T cell population [FIGS. 25E and 25F]. These data support the notion that systemic blockade of PD-1 signaling may have a more global impact on the bulk T cell population including the activation of STAT3 signaling and Ki67, but that these changes may be insufficient by themselves to manifest significant functional output (as also evidenced by the failure of anti-PD-1 monotherapy or fusion protein treatments to induce a more generalized T cell expansion).

To better understand how changes in proximal signaling might specifically impact PD-1 expressing T cells, and because PD-1(+) T cells reflect only a small fraction of the bulk T cell population in the peripheral blood, these cells were examined more directly by gating on PD-1(+) CD4 and CD8 T cells using a non-competing PD-1 detection mAb [FIGS. 16 and 17]. After an initial mild reduction in absolute numbers of circulating PD-1(+) cells, this population remained stable in the [22D4.017] antibody group. In contrast, after an initial reduction in the numbers of peripheral blood PD-1(+) CD4 and CD8 T cells, there was a significant rebound (above baseline) in the number of PD-1(+) cells observed at 336 h post-dosing in the [22D4.017]-[R9E:R76A] (monomer) fusion protein treatment group population [FIG. 25G]. Thus, despite the lack of significant expansion of the bulk population, these data suggest that PD-1(+) T cell numbers are increased selectively upon administration of the [22D4.017]-[R9E:R76A](monomer) fusion protein.

To determine a possible functional impact of the expansion of PD-1(+) T cells, a relationship between the expansion of PD-1(+) CD4/8 T cells and serum perforin was examined. Indeed, the data suggest that there is a positive relationship between these two parameters: serum perforin is highest in animals administered the [22D4.017]-[R9E:R76A] (monomer) fusion protein, which experienced significant increase in peripheral blood PD-1(+) T cells [FIG. 25I].

Taken together these data suggest that, although systemic exposure of the [22D4.017]-[R9E:R76A] (monomer) fusion protein failed to manifest an increase in the total bulk T cell population, blockade of PD-1 and concurrent delivery of IL-21 signal on the same cell (expressing PD-1) is sufficient to induce population expansion. This also correlates with an increase in serum perforin [FIG. 25I].

Example 15

The following example demonstrates the binding affinities of various anti-PD-1 antibodies.

The anti-PD-1 antibody::PD-1 Octet binding affinities where characterized as follows. To quantitate the $K_D$ binding affinity (equilibrium dissociation constant) between the anti-PD-1 antibodies and recombinant, soluble human and cynomolgus macaque PD-1, association and dissociation rate constants were measured using either a Pall® ForteBio® Octet® RED384 instrument in 16 tip mode or a Pall® Octet® HTX instrument in 96 tip mode. In all cases, second generation amine reactive fiber optic biosensor tips (AR2G) were used to covalently capture the antibodies to final loading levels between 2.5 and 4 nm. The binding assay method used the following immobilization steps: (1) equilibration in water, 60 seconds; (2) activation with fresh 20 mM 1-Ethyl-3-[3-dimethylaminopropyl] carbodiimide hydrochloride (EDC) mixed with 10 mM N-hydroxysulfosuccinimide (sulfo-NHS), 600 seconds; (3) immobilization of 20 nM antibodies diluted in 10 mM acetate pH 6.0 buffer, 2000 seconds; (4) quenching with 1M ethanolamine, 300 seconds; and finally (5) a baseline incubation in Octet running buffer (10 mM TRIS pH 7.5, 150 mM NaCl, 1 mM $CaCl_2$, 0.13% (v/v) Triton X-100 and 0.10 mg/ml Bovine Serum Albumin(BSA), 60 seconds. All experiments were run with the manufacture-suggested 384 well black sample plates (100 μl volume per well) at 27° C. and 1000 RPM.

For each Ab::PD-1 interaction, a column of eight tips were equally immobilized as described above with the same antibody. Three tips were used to bind a three-point dilution series of soluble human PD-1(1-170)-FLAG-His, three more tips were used to bind a three-point dilution series of soluble cyno PD-1(1-167)-FLAG-His and then the remaining two tips (with Ab immobilized like the rest of the tips in the column) were exposed to Octet® buffer so they could be reference tips. All fiber optic tips were used once and then disposed; i.e. no regeneration. Human and cyno PD-1 binding curves were generated by creating a 1:3 fold serial dilution series of the soluble PD-1 receptor in Octet running buffer; final PD-1 concentrations were 30, 10 and 3.3 nM (except for the IgG4 anti-PD-1 mAb which was PD-1 concentration 33, 11, 3.7 nM). Fiber optic biosensors with the immobilized antibodies were incubated in the wells containing the PD-1 serial dilution series for 300 seconds (association step) and then moved to wells with just the running buffer for 500 seconds (dissociation step).

The raw data was processed with the instrument data analysis software (v10). For each column of sensors, the binding signal of the two reference sensors was averaged and subtracted from the remaining six sample sensors. Reference-subtracted data was then processed with the default software options: Y-axis aligned to the baseline, inter-step correction to the dissociation and finally processed with a Savitzky-Golay filter. Final processed data for each antibody binding to either three human or to three cyno PD-1 concentrations was then globally fit to a 1:1 binding model and graphed. All graphs show both processed data as well as the fit to the 1:1 binding model. The 1:1 binding model fit was used to determine the association rate constant ($k_a$; units $M^{-1}$ $sec^{-1}$) and the dissociation rate constant ($k_d$; units $sec^{-1}$). The equilibrium dissociation constant ($K_D$; units nanomolar (nM)=$1\times10^{-9}$ Mol/L) was then calculated the as a ratio of $k_d/k_a$.

FIG. 26A-26J show the binding profiles for anti-PD-1 antibodies 22D4.017, 20C1.009, and 20A2.003, tested side by side with two anti-PD-1 mAbs (an IgG1 anti-PD-1 mAb and an IgG4 anti-PD-1 mAb). The binding profiles were determined using the ForteBio Octet® system. The binding is shown against human and cyno PD-1 receptors.

As shown in FIGS. 26A-26E, the 22D4.017, 20C1.009 and 20A2.003 PD-1 antibodies exhibited $K_D$ values that were 2-to-14 fold greater than commercially available antibodies when tested against the human PD-1 protein. In addition, analysis of the cross-reactivity of cyno PD-1 protein with 22D4.017, 20C1.009 and 20A2.003 antibodies showed an overall similar affinity, whereas commercially available antibodies showed around 2-fold difference in affinity (FIG. 26F-26J).

Example 16

The following example demonstrates the stability of various anti-PD-1 antibodies.

Thermal conformational stability of the anti-PD-1 antibodies was characterized as follows. Antibodies 20C1.009 and 22D4.017 were evaluated for thermal stability by differential scanning calorimetry (DSC). DSC is a technique that measures heat capacities a function of temperature. The signal from the sample cell is compared to a reference cell lacking the protein. As the temperature of the cells are raised the enthalpy and melting temperature, peak width is measured for each unfolding transition. This provides information on the thermal stability and higher order structure of the protein, including thermal stability of the protein domains. FIG. 27 represents a DSC Thermogram of each anti-PD-1 antibody at 1 mg/mL in A52SuT and Table 21 provides the Tm for each antibody tested.

TABLE 21

| Antibody | 20C1.009 | 22D4.017 |
|---|---|---|
| Tm by DSC | 75.1° C. | 66.1° C. |

Viscosity was additionally determined using a cone and plate (TA Instruments, New Castle, Del.) by measuring the flow resistance due to the frictional forces between molecules. A flow sweep procedure was applied from 100 to 1000 s-1 using a 20 mm 1.988° cone plate and Peltier plate Steel—990918. Viscosity was measured in Pa*s, where 1 m Pa*s=1 cP at 1000 s-1. Viscosity was measured for each antibody at 70 and 150 mg/mL with 0.01% surfactant added to the formulation buffer (A52Su). All samples were measured at room temperature. Viscosity data (1000 Shear Rate) is shown in FIG. 28 and provided in Table 22.

TABLE 22

| Antibody | cP 70 mg/mL | cP 150 mg/mL |
|---|---|---|
| 22D4.017 | 3.4 | 44.7 |
| 20C1.009 | 2.5 | 7.1 |

An antibody's stability properties are important factors considered during the development of therapeutic candidates. For example, an antibody's propensity to aggregate (formation of large complexes in solution that can lead to precipitation) can impact shelf life, administration mode (e.g., i.v. vs subcutaneous), and molecule activity. Typically, an antibody's thermostability and viscosity properties are good indicators of an antibody's ability to maintain structural integrity at high temperatures and high concentrations. As the data above demonstrate, 20C1.009 exhibits stability properties that make it particularly suitable as a therapeutic which is amenable to both i.v. and subcutaneous (and high concentration) administration.

Example 17

This example demonstrates IL-21 activity elicited by various fusion proteins.

Various fusion proteins comprising an IL-21 mutein were made and tested for IL-21 activity using the pSTAT3 AlphaLISAR assay. One comprised an anti-TIGIT monoclonal antibody (mAb), while a second comprised an anti-LAG3 mAb. Four cell lines were generated for use in these experiments: (A) a variant Hut78 T cell line that is PD-1 positive, (B) a variant Hut78 T cell line that is TIGIT positive, (C) a variant Hut78 T cell line that is LAG3 positive, and (D) the parental Hut78 T cell line which does not endogenously express PD-1, TIGIT or LAG3. All four cell lines were exposed to (i) rhIL-21 alone, (ii) anti-PD-1 mAb alone, (iii) anti-TIGIT mAb alone, (iv) anti-LAG3 mAb alone, (v) anti-PD-1 mAb fused to an IL-21 (R5Q:R76E) mutein (monomer), (vi) anti-TIGIT mAb fused to an IL-21 (R5Q:R76E) mutein (dimer), and (vii) anti-LAG3 mAb fused to an IL-21 (R5Q:R76E) mutein (dimer).

The results of the STAT3 phosphorylation assay and the EC50s of each molecule for STAT signaling are shown in FIGS. 29A-29D and Table 23, respectively.

TABLE 23

| Molecule | Hut78 Parental EC50 (pM) | Hut78/PD-1 EC50 (pM) | Hut78/TIGIT EC50 (pM) | Hut78/Lag3 EC50 (pM) |
|---|---|---|---|---|
| rhIL-21 | 65 | 59 | 58 | 68 |
| Anti-PD-1 mAb | — | — | — | — |
| Anti-TIGIT mAb | — | — | — | — |
| Anti-LAG3 mAb | — | — | — | — |

TABLE 23-continued

| Molecule | Hut78 Parental EC50 (pM) | Hut78/PD-1 EC50 (pM) | Hut78/TIGIT EC50 (pM) | Hut78/Lag3 EC50 (pM) |
|---|---|---|---|---|
| Fusion of Anti-PD-1 mAb + IL-21 mutein | — | 341 | — | — |
| Fusion of Anti-TIGIT mAb + IL-21 mutein | — | — | 1390 | — |
| Fusion of Anti-LAG3 mAb + IL-21 mutein | — | — | — | — |

As shown in FIGS. 29A-29D and Table 23, the anti-TIGIT and anti-LAG3 fusion proteins exhibited significantly reduced potency (anti-TIGIT) or no measurable potency (anti-LAG3) compared to rhIL-21.

Example 18

NOD.Cg-Prkdc$^{scid}$ Il2rg$^{tm1Wjl}$/SzJ (Jax stock number 005557) mice were used at 6-8 weeks of age. As shown in FIG. 30A, on day 0, animals were reconstituted with 2.5×10$^6$ freshly thawed CTLs in 100 μl in PBS, 2×10$^5$ EU IL-2 (Peprotech, catalogue #200-02-1 mg, lot #11172) in 0.02% BSA in PBS in 100 μl by intraperitoneal injection. In addition mice were engrafted with 1×10$^6$ CMV peptide-expressing human (PD-L1$^+$) melanoma cells (SKMEL-30-Luc) engineered to express a model antigen (CMV-SKMEL-30-Luc, expressing peptide antigens (pp65m 1E1 and UL138) derived from cytomegalovirus, CMV) in 100 μl in a 50:50 mixture of growth factor reduced Matrigel (Corning) and serum-free RPMI subcutaneously on the right hind flank. Animals received two additional boosters of IL-2 on day 2 and day 11. On day 17, tumor volumes were determined, mice were randomized into study groups, and treatments were initiated: Isotype 300 g IP Q3Dx3 (BioXCell), anti-PD-1 mAb (chimera consisting of anti-human PD1 variable region and mouse IgG1 constant region) 300 g IP Q3Dx3, anti-PD-1 mAb×R9E:R76A (chimera consisting of anti-human PD-1 variable region, a mouse IgG1 constant region and a C-terminus fusion of human IL-21 variant R9E:R76A) fusion protein monomer 363 μg IP Q3DX3. Tumor volumes were measured twice/week. All experimental studies were conducted under protocols approved by the Institutional Animal Care and Use Committee of Amgen. Animals were housed at Association for Assessment and Accreditation of Laboratory Animal Care International-accredited facilities (at Amgen) in ventilated microisolator housing on corncob bedding. Animals had access ad libitum to sterile pelleted food and reverse osmosis-purified water and were maintained on a 12:12 hour light:dark cycle with access to environmental enrichment opportunities.

Humanized mice (generated as described above) were engrafted with human (PD-L1) melanoma cells (SKMEL-30-Luc) engineered to express a model antigen (CMV-SKMEL-30-Luc, expressing peptide antigen derived from cytomegalovirus, CMV). The mice were treated with either [1] a human-mouse chimeric anti-PD-1 mAb, with a variable domain recognizing human PD-1 and a constant Fc-region from mouse IgG1; or [2] a fusion protein consisting of the same parent anti-PD-1 mAb and a monomeric human IL-21 R9E:R76A (a schematic of which is shown in FIG. 30C). A summary of molecule attributes is shown in Table 24.

TABLE 24

| | Hut78 PD-1 (−) Interpolated EC50 (nM) | Hut78 PD1 (+) Interpolated EC50 (nM) | PD-1 reporter Interpolated EC50 (nM) | huIL-21R (nM) | muIL-21R (nM) | hPD-1 (nM) | muPD-1 (nM) |
|---|---|---|---|---|---|---|---|
| IgG1 isotype control | — | — | — | — | — | — | — |
| rhIL-21 | 0.009 | 0.009 | — | 0.052 | ~90 | — | — |
| PD1 mAb | — | — | 2.035 | — | — | 3.4 | — |
| PD1 mAb × R9E:R76A monomer | >1000 | 1.97 | 1.613 | >300 | — | 2.6 | — |

On the same day as tumor engraftment, mice received adoptively transferred antigen (CMV)-specific CTLs having potent in vitro cytotoxicity against the antigen-expressing cancer cells. In this model, the failure of tumor reactive CTLs to control cancer growth leads to development of progressive tumors which are palpable by day 17. Therapeutic administration (into mice with −100 mm$^3$ established tumors) with an isotype control antibody or an anti-PD-1 mAb failed to resolve the disease or have any discernable impact on tumor growth (FIGS. 30D-30E)). In contrast, therapeutic administration of a PD1×IL-21 fusion protein (Table 24), has a significant inhibitory effect on the tumor growth and improves overall survival (FIGS. 30B, 30E, and 30F). Collectively our data support the idea that chronic activation of T cells can lead to a diminished anti-tumor immune response, and that administration of a fusion protein consisting of a PD-1-targeted IL-21 moiety can significantly extend the function of CTLs and support superior tumor control in a mouse model that is refractory to anti-PD-1 mAb monotherapy.

Example 19

Generation of PD-L1 Overexpression Cell Lines.

GP2-293 cells were cultured in DMEM media supplemented with 10% fetal bovine serum, 1% Pen/Strep, 1% HEPES, and 1% GlutaMAX. Cells were plated at 75% confluency in 10 cm dishes and incubated at 37° C., 5% $CO_2$ overnight. The next morning, cells were transfected. To tube A, 45 μL of Lipofectamine 3000 and 500 μL of OptiMEM media were added. To tube B, 15 μg of MSCV_GFP_PD-L1 plasmid, 1.8 μg of VSV-g plasmid, 30 μL P3000 reagent, and 500 μL of OptiMEM media were added. Tubes A and B were mixed and incubated at room temperature for 10 minutes, then the contents of tube B was added to tube A and incubated at room temperature for 20 minutes. The mixture was added dropwise to dishes of GP2-293 cells which were incubated at 37° C., 5% $CO_2$ overnight. The next morning, the media was removed and replaced with 10 mL of fresh culture media. That afternoon, target cells were plated at 75% confluence in 6 well plates and incubated at 37° C., 5% $CO_2$ overnight. The following morning, viral supernatants were collected from GP2-293 cells and centrifuged (5 minutes, 1200 rpm). Supernatants were collected in a new tube, and polybrene was added at 1:1000. Media was removed from plates containing target cells and 2 mL of viral supernatant was added. For suspension cells, 1E6 cells were centrifuged at 1500 rpm for 5 minutes, resuspended in 500 μL RPMI supplemented with 10% fetal bovine serum and 1% pen/strep, and plated in 6 wells plates to which was added 2 mL of viral supernatant. Plates containing target cells and viral supernatants were centrifuged for 1.5 hours at 1200×g at 32° C. then incubated at 37° C., 5% $CO_2$. Culture media was added after 5 hours. Four days later, cells were analyzed for GFP and PD-L1 expression by flow cytometry with a FACSymphony. PD-L1 was detected using a PE-conjugated antibody, clone 29E.2A3. Cells <70% positive for PD-L1 expression were sorted on a BD Melody sorter.

Example 20

TDCC Combination with 20C1.009.

T cell dependent cellular cytotoxicity (TDCC) assay: BiTE® molecules were diluted in cell culture media (RPMI, 10% heat inactivated fetal bovine serum, 1× GlutaMAX, 1× Pen/Strep), serially diluted (1:3, 22 total) and transferred to black, clear bottom 384-well plates using a Bravo liquid handling robot. Human pan T cells (n=4), pre-activated with CD3/CD28 Dynabeads (1:1, 48 hours), were separated from beads using a magnet and diluted in cell culture media. An aliquot of activated T cells from each donor was assessed for PD-1 expression by flow cytometry. Cells were stained as described above and data was collected on a FACSymphony flow cytometer and analyzed using FlowJo v10.1. Activated T cells (2500 cells/20 μL; 4 rows/donor) followed by target cells overexpressing PD-L1 were plated in 384-well assay plates (2500 cells/20 μL; full plate) such that the final effector to target cell (E:T) ratio was 1:1. 20C1.009 (10 μg/mL final in 5 μL) was added to 2 rows of each T cell donor. Plates were covered with MicroClime lids and incubated at 37° C., 5% $CO_2$ for 24 hours. To assays with target cells expressing luciferase, 30 μL of Steady-Glo, Bright-Glo, or One-Glo reagent (Promega) was added. Plates with adherent target cells not expressing luciferase were washed with PBS to remove T cells using EL406 plate washer and 25 μL Cell Titer Glo reagent was added. Plates were incubated with reagent for 10 minutes in the dark at room temperature. Luminescence was detected using a BioTek Neo plate reader. Specific cytotoxicity was calculated relative to target cells incubated with T cells without BiTE. Graphpad Prism software was used to plot dose curves and calculate EC50 values with four parameter variable slope curve fitting.

FIGS. 33A-41B show the results of the TDCC assay described above. FIGS. 33A-41A show the data of one representative T cell donor, while FIGS. 33B-41B show the data of four different T cell donors. Together, the data of FIGS. 33A-41B demonstrate improved killing of target cells with the various bispecific anti-CD3×anti-TAA single chain antibody constructs when they are combined with anti-PD1 antibody 20C1.009.

Example 21

Single Chain Antibody Construct-Induced PD-1 Expression on T Cells.

Single chain antibody constructs were diluted in cell culture media (RPMI, 10% heat inactivated fetal bovine serum, 1× GlutaMAX, 1× Pen/Strep) to 50 nM and serially diluted (1:5, 9 total). Serial dilutions were plated in duplicate in assay plates (40 μL). Flat bottom 96-well plates were used for adherent target cell lines. Round bottom 96-well plates were used for suspension target cell lines. Human pan T cells thawed and resuspended in cell culture media (80 μL of 0.625E6 cells/mL) were added to assay plates followed by target cell lines (80 μL of 0.125E6 cells/mL). Plates were covered with MicroClime lids and incubated at 37° C., 5% $CO_2$ for 48 hours. Assays cultured in flat bottom plates were pipetted up and down to enable transfer of T cells to round bottom FACS plates. These and round bottom assay plates were centrifuged (3 minutes, 1500 rpm, RT) and cell culture supernatants were discarded. Cell pellets were resuspended in blocking buffer (50 μL of PBS/2% FBS, 2% normal goat serum, 2% normal mouse serum, 2% human Fc block) and incubated at room temperature for 15 minutes. Antibody cocktail was added (60 uL of PE-Cy7 anti-CD3, PerCPCy5.5 anti-CD8, BUV395 anti-CD4, FITC anti-CD69, PE anti-CD25, BV650 anti-PD-1) and plates were incubated at 4° C., dark, for 20 minutes. Cells were washed with 200 uL of PBS/2% FBS and centrifuged for 3 minutes at 1500 rpm at 4° C. Cells were resuspended in 90 μL of PBS/2% FBS with Sytox Blue (1:200). Data was collected on a FACSymphony flow cytometer and analyzed using FlowJo v10.1.

Example 22

Efficacy of Anti-PD-1 Antibody Combined with Single Chain Antibody Constructs in Syngeneic Tumor Model In Vivo Studies.

Syngeneic tumor cells engineered to express antigens recognized by single chain antibody constructs are injected subcutaneously into the lower flank of mice engineered to express both human PD-1 and human CD3. Treatment with either: [1] an anti-PD-1 antibody (e.g., 20C1.009); [2] a single chain antibody construct (e.g., any of the single chain antibody constructs described herein); or [3] both an anti-PD-1 antibody (e.g., 20C1.009) and a single chain antibody construct is initiated when tumors reach a volume of 50-150 $mm^3$ and proceeds for approximately 14 days. Single chain antibody constructs are administered by intravenous injection every 7 days for a total of two doses at dose levels ranging from 50 to 1000 μg/kg. The anti-PD-1 antibody is administered by intraperitoneal injection at a dose level of 300 μg every 3 days for a total of three doses. Tumor volume is assessed by measurement with calipers.

Combination of an anti-PD-1 antibody (e.g., 20C1.009) with a single chain antibody construct results in greater tumor shrinkage than treatment with either the anti-PD-1 antibody or the single chain antibody construct alone.

Example 23

Tumor Growth Evaluation in Subcutaneous (SC) Mouse Tumor Model.

Single agent and combination efficacy: mouse melanoma cells (B16F10 cells engineered to constitutively express human EpCAM (huEpCAM)) were injected SC in the right flank of mice ($3\times10^5$ cells/mouse) expressing human CD3c. Tumor volume ($mm^3$) was measured using electronic calipers twice per week (Q2W). Once tumors reached an average size of 90 $mm^3$, animals were randomized into groups (10 mice per group) such that the average tumor volume at the beginning of treatment administration was uniform across treatment groups. Animals were then intravenously (IV) administered with two doses of huEpCAM HLE single chain antibody construct (huEpCAM HLE BiTE®) or Control single chain antibody construct (EGFRvIII HLE BiTE®; Control BiTE®) 1 week apart. Anti-PD-1 antibody was administered intraperitoneally (IP) Q3D for 3 doses, beginning on the same day as single chain antibody construct treatment. Clinical signs, body weight changes, and tumor growth were measured 2 times weekly until study termination.

Tumor volume analysis: Single agent in vivo efficacy data was analyzed by RMANOVA followed by Dunnett's correction. Combination in vivo efficacy data were analyzed by RMANOVA where by each single agent vs combination. These data demonstrate that the combination of single chain antibody constructs and an anti-PD-1 antibody results in significant tumor growth inhibition versus either single agent. See FIG. 31.

Survival analysis: In vivo efficacy data were analyzed by Kaplan-Meier analysis of median survival of mice treated single agents or single agent vs combination. These data demonstrate that the combination of single chain antibody constructs and an anti-PD-1 antibody results in improved survival versus either single agent. See FIG. 32.

Animal Care. Female BALB/c mice (Charles 127 River Laboratories, Wilmington, Mass.), 6-8 weeks of age were cared for in accordance with the "Guide for the Care and Use of Laboratory Animals". Animals were housed at Association for Assessment and Accreditation of Laboratory Animal Care International-accredited facilities (at Amgen) in ventilated micro-isolator housing on corncob bedding. All protocols were approved by an Institutional Animal Care and Use Committee. Animals had ad libitum access to sterile pelleted feed and reverse osmosis-purified water and were maintained on a 12:12 hour light:dark cycle with access to environmental enrichment opportunities.

Example 24

Efficacy of Anti-PD-1 Antibodies Combined with Single Chain Antibody Constructs in Human Admixture Tumor Model In Vivo Studies.

Human cancer cells expressing antigens recognized by single chain antibody constructs are mixed with activated human CD3+ T cells at a ratio of $5\times10^6$+$1\times10^6$ cells respectively. Cells are injected subcutaneously into the right flank of female athymic nude mice. Tumor volume ($mm^3$) is measured using electronic calipers twice per week (Q2W). Once tumors reached an average of approximately 150 $mm^3$, animals are randomized into groups (10 mice per group) such that the average tumor volume at the beginning of treatment is uniform across treatment groups. Animals are then intravenously (i.v.) administered with two doses of HLE single chain antibody construct or Control single chain antibody construct 1 week apart. Anti-PD-1 antibody (e.g., 20C1.009) is administered intraperitoneally (i.p.) Q3D for 3 doses, beginning on the same day as single chain antibody construct treatment. Clinical signs, body weight changes, and tumor growth are measured 2 times weekly until study termination.

CD3+ T Cell Activation.

$1\times10^6$ human T-cells are thawed and T cell stimulation beads are added to induce T-cell expansion. IL-2 is added to the media three days later at 5 μg/mL and cells are expanded in IL-2 containing media for two weeks. Activated T cells are harvested and de-beaded using magnets.

Statistical Analysis.

Tumor Volume Analysis:

Single agent in vivo efficacy data is analyzed by RMANOVA followed by Dunnett's correction. Combination in vivo efficacy data are analyzed by RMANOVA where by each single agent vs combination.

Survival Analysis:

In vivo efficacy data is analyzed by Kaplan-Meier analysis of median survival of mice treated single agents or single agent vs combination.

Combination of an anti-PD-1 antibody (e.g., 20C1.009) with a single chain antibody construct results in greater tumor shrinkage than treatment with either the anti-PD-1 antibody or the BiTE® antibody construct alone.

Example 25

Efficacy of CAR T Cells Directed Against DLL3 Combined with Anti-PD-1 Antibody in an In Vivo Xenograft Model Human cancer cells expressing DLL3 antigens recognized by CAR T cells directed against DLL3 (using any one of SEQ ID NO: 746-751) are implanted subcutaneously into SCID beige mice ($5\times10^6$ cells/mouse) on Day 0. Tumor volume ($mm^3$) is measured using calipers twice per week (Q2W). Once tumors reach an average size of 75-100 $mm^3$, animals are randomized into groups (9-10 mice per group) such that the average tumor volume at the beginning of treatment is uniform across treatment groups. Animals are then intravenously (IV) administered with one dose of CAR T cells ($1\times10^7$ antigen-specific CAR T cells or $1\times10^7$ Control CAR T cells) in a volume of 200 μl. Anti-PD-1 antibody (is administered intraperitoneally (IP) Q3D at 300 μg for 3 doses, beginning on the same day as CAR T cell treatment. Clinical signs, body weight changes, and tumor growth are measured twice weekly until study termination (~45 days).

Example 26

In Vitro Evaluation of CAR T Cell-Mediated Cytotoxicity Against DLL3 in Combination with an Anti-PD-1 Antibody CAR T cells (2500 cells/20 μL; 4 rows/donor) directed against DLL3 (using any one of SEQ ID NO: 746-751) and target cells overexpressing PD-L1 are plated in 384-well assay plates (2500 cells/20 pL) such that the final effector to target cell (E:T) ratio is 1:1. AMG 404 (10 μg/mL final in 5 μL) is added. Plates are covered with MicroClime lids and incubated at 37° C., 5% CO2 for 24 hours. Next, 30 L of Steady-Glo, Bright-Glo, or One-Glo reagent (Promega) is added. Plates are incubated with reagent for 10 minutes in the dark at room temperature. Luminescence is detected using a BioTek Neo plate reader. Specific cytotoxicity is calculated relative to target cells incubated with T cells without BiTE. Graphpad Prism software is used to plot dose-response curves and calculate EC50 values with four parameter variable slope curve fitting.

Example 27

Efficacy of CAR T Cells Directed Against FLT3 Combined with Anti-PD-1 Antibody in an In Vivo Xenograft Model Human cancer cells expressing antigens against FLT3 recognized by CAR T cells directed against FLT3 (using any one of SEQ ID NO: 763-774) are implanted subcutaneously into SCID beige mice ($5\times10^6$ cells/mouse) on Day 0. Tumor volume ($mm^3$) is measured using calipers twice per week (Q2W). Once tumors reach an average size of 75-100 $mm^3$, animals are randomized into groups (9-10 mice per group) such that the average tumor volume at the beginning of treatment is uniform across treatment groups. Animals are then intravenously (IV) administered with one dose of CAR T cells ($1\times10^7$ antigen-specific CAR T cells or $1\times10^7$ Control CAR T cells) in a volume of 200 µl. Anti-PD-1 antibody (is administered intraperitoneally (IP) Q3D at 300 µg for 3 doses, beginning on the same day as CAR T cell treatment. Clinical signs, body weight changes, and tumor growth are measured twice weekly until study termination (~45 days).

Example 28

In Vitro Evaluation of CAR T Cell-Mediated Cytotoxicity Against FLT3 in Combination with an Anti-PD-1 Antibody CAR T cells (2500 cells/20 µL; 4 rows/donor) directed against FLT3 (using any one of SEQ ID NO: 763-774) and target cells overexpressing PD-L1 are plated in 384-well assay plates (2500 cells/20 pL) such that the final effector to target cell (E:T) ratio is 1:1. AMG 404 (10 µg/mL final in 5 µL) is added. Plates are covered with MicroClime lids and incubated at 37° C., 5% CO2 for 24 hours. Next, 30 L of Steady-Glo, Bright-Glo, or One-Glo reagent (Promega) is added. Plates are incubated with reagent for 10 minutes in the dark at room temperature. Luminescence is detected using a BioTek Neo plate reader. Specific cytotoxicity is calculated relative to target cells incubated with T cells without BiTE. Graphpad Prism software is used to plot dose-response curves and calculate EC50 values with four parameter variable slope curve fitting.

All references, including publications, patent applications, and patents, cited herein are hereby incorporated by reference to the same extent as if each reference were individually and specifically indicated to be incorporated by reference and were set forth in its entirety herein.

The use of the terms "a" and "an" and "the" and similar referents in the context of describing the disclosure (especially in the context of the following claims) are to be construed to cover both the singular and the plural, unless otherwise indicated herein or clearly contradicted by context. The terms "comprising," "having," "including," and "containing" are to be construed as open-ended terms (i.e., meaning "including, but not limited to,") unless otherwise noted.

Recitation of ranges of values herein are merely intended to serve as a shorthand method of referring individually to each separate value falling within the range and each endpoint, unless otherwise indicated herein, and each separate value and endpoint is incorporated into the specification as if it were individually recited herein.

All methods described herein can be performed in any suitable order unless otherwise indicated herein or otherwise clearly contradicted by context. The use of any and all examples, or exemplary language (e.g., "such as") provided herein, is intended merely to better illuminate the disclosure and does not pose a limitation on the scope of the disclosure unless otherwise claimed. No language in the specification should be construed as indicating any non-claimed element as essential to the practice of the disclosure.

Preferred embodiments of this disclosure are described herein, including the best mode known to the inventors for carrying out the disclosure. Variations of those preferred embodiments may become apparent to those of ordinary skill in the art upon reading the foregoing description. The inventors expect skilled artisans to employ such variations as appropriate, and the inventors intend for the disclosure to be practiced otherwise than as specifically described herein. Accordingly, this disclosure includes all modifications and equivalents of the subject matter recited in the claims appended hereto as permitted by applicable law. Moreover, any combination of the above-described elements in all possible variations thereof is encompassed by the disclosure unless otherwise indicated herein or otherwise clearly contradicted by context.

SEQUENCE LISTING (774 sequences)

SEQ ID NO: 1 - protein, 133 aa, Artificial Sequence a [sequence omitted]

SEQ ID NO: 2 - protein, 133 aa, Artificial Sequence
  Synthetic Polypeptide
  MISC_FEATURE (5)..(5): Xaa is any amino acid
  MISC_FEATURE (8)..(9): Xaa is any amino acid
  MISC_FEATURE (11)..(16): Xaa is any amino acid
  MISC_FEATURE (19)..(19): XaXaa is any amino acid
  MISC_FEATURE (23)..(23): Xaa is any amino acid
  MISC_FEATURE (65)..(66): Xaa is any amino acid
  MISC_FEATURE (68)..(73): Xaa is any amino acid
  MISC_FEATURE (75)..(80): Xaa is any amino acid
  MISC_FEATURE (109)..(110): Xaa is any amino acid
  MISC_FEATURE (112)..(113): Xaa is any amino acid
  MISC_FEATURE (116)..(117): Xaa is any amino acid
  MISC_FEATURE (119)..(120): Xaa is any amino acid
  MISC_FEATURE (123)..(123): Xaa is any amino acid
QGQDXHMXXMXXXXXXVDXLKNXVNDLVPEFLPAPEDVETNCEWSAFSCFQKAQLKSANTGNNEXXIXXXXXXLXXXXXXTNAGRRQKHRLTCPSCDSYEKKPPKEFLXXFXXLLXXMXXQHXSSRTHGSEDS

SEQ ID NO: 3 - protein, 133 aa, Artificial Sequence
  Synthetic Polypeptide
  MISC_FEATURE (5)..(5): Xaa is any amino acid
QGQDXHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 4 - protein, 133 aa, Artificial Sequence
  Synthetic Polypeptide
  MISC_FEATURE (8)..(8): Xaa is any amino acid
QGQDRHMXRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 5 - protein, 133 aa, Artificial Sequence
  Synthetic Polypeptide
  MISC_FEATURE (9)..(9): Xaa is any amino acid
QGQDRHMIXMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 6 - protein, 133 aa, Artificial Sequence
  Synthetic Polypeptide
  MISC_FEATURE (11)..(11): Xaa is any amino acid
QGQDRHMIRMXQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 7 - protein, 133 aa, Artificial Sequence
  Synthetic Polypeptide
  MISC_FEATURE (12)..(12): Xaa is any amino acid
QGQDRHMIRMRXLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 8 - protein, 133 aa, Artificial Sequence
  Synthetic Polypeptide
  MISC_FEATURE (13)..(13): Xaa is any amino acid
QGQDRHMIRMRQXIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 9 - protein, 133 aa, Artificial Sequence
  Synthetic Polypeptide
  MISC_FEATURE (14)..(14): Xaa is any amino acid
QGQDRHMIRMRQLXDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 10 - protein, 133 aa, Artificial Sequence
  Synthetic Polypeptide
  MISC_FEATURE (15)..(15): Xaa is any amino acid
QGQDRHMIRMRQLIXIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 11 - protein, 133 aa, Artificial Sequence
  Synthetic Polypeptide
  MISC_FEATURE (16)..(16): Xaa is any amino acid
QGQDRHMIRMRQLIDXVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 12 - protein, 133 aa, Artificial Sequence
  Synthetic Polypeptide
  MISC_FEATURE (19)..(19): Xaa is any amino acid
QGQDRHMIRMRQLIDIVDXLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 13 - protein, 133 aa, Artificial Sequence
  Synthetic Polypeptide
  MISC_FEATURE (23)..(23): Xaa is any amino acid
QGQDRHMIRMRQLIDIVDQLKNXVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 14 - protein, 133 aa, Artificial Sequence
  Synthetic Polypeptide
  MISC_FEATURE (65)..(65): Xaa is any amino acid
QGQDRHMIRMRQLIDIVDQLKNYVNDLVPEFLPAPEDVETNCEWSAFSCFQKAQLKSANTGNNEXIINVSIKKLKRKPPSTNAGRRQKHRLTCPSCDSYEKKPPKEFLERFKSLLQKMIHQHLSSRTHGSEDS

SEQ ID NO: 15 - protein, 133 aa, Artificial Sequence
  Synthetic Polypeptide
  MISC_FEATURE (66)..(66): Xaa is any amino acid
QGQDRHMIRMRQLIDIVDQLKNYVNDLVPEFLPAPEDVETNCEWSAFSCFQKAQLKSANTGNNERXINVSIKKLKRKPPSTNAGRRQKHRLTCPSCDSYEKKPPKEFLERFKSLLQKMIHQHLSSRTHGSEDS

SEQ ID NO: 16 - protein, 133 aa, Artificial Sequence
  Synthetic Polypeptide
  MISC_FEATURE (68)..(68): Xaa is any amino acid
QGQDRHMIRMRQLIDIVDQLKNYVNDLVPEFLPAPEDVETNCEWSAFSCFQKAQLKSANTGNNERIIXVSIKKLKRKPPSTNAGRRQKHRLTCPSCDSYEKKPPKEFLERFKSLLQKMIHQHLSSRTHGSEDS

SEQ ID NO: 17 - protein, 133 aa, Artificial Sequence
  Synthetic Polypeptide
  MISC_FEATURE (69)..(69): Xaa is any amino acid
QGQDRHMIRMRQLIDIVDQLKNYVNDLVPEFLPAPEDVETNCEWSAFSCFQKAQLKSANTGNNERIINXSIKKLKRKPPSTNAGRRQKHRLTCPSCDSYEKKPPKEFLERFKSLLQKMIHQHLSSRTHGSEDS

SEQ ID NO: 18 - protein, 133 aa, Artificial Sequence
  Synthetic Polypeptide
  MISC_FEATURE (70)..(70): Xaa is any amino acid
QGQDRHMIRMRQLIDIVDQLKNYVNDLVPEFLPAPEDVETNCEWSAFSCFQKAQLKSANTGNNERIINVXIKKLKRKPPSTNAGRRQKHRLTCPSCDSYEKKPPKEFLERFKSLLQKMIHQHLSSRTHGSEDS

SEQ ID NO: 19 - protein, 133 aa, Artificial Sequence
  Synthetic Polypeptide
  MISC_FEATURE (71)..(71): Xaa is any amino acid
QGQDRHMIRMRQLIDIVDQLKNYVNDLVPEFLPAPEDVETNCEWSAFSCFQKAQLKSANTGNNERIINVSXKKLKRKPPSTNAGRRQKHRLTCPSCDSYEKKPPKEFLERFKSLLQKMIHQHLSSRTHGSEDS

SEQ ID NO: 20 - protein, 133 aa, Artificial Sequence
  Synthetic Polypeptide
  MISC_FEATURE (72)..(72): Xaa is any amino acid
QGQDRHMIRMRQLIDIVDQLKNYVNDLVPEFLPAPEDVETNCEWSAFSCFQKAQLKSANTGNNERIINVSIXKLKRKPPSTNAGRRQKHRLTCPSCDSYEKKPPKEFLERFKSLLQKMIHQHLSSRTHGSEDS

SEQ ID NO: 21 - protein, 133 aa, Artificial Sequence
  Synthetic Polypeptide
  MISC_FEATURE (73)..(73): Xaa is any amino acid
QGQDRHMIRMRQLIDIVDQLKNYVNDLVPEFLPAPEDVETNCEWSAFSCFQKAQLKSANTGNNERIINVSIKXLKRKPPSTNAGRRQKHRLTCPSCDSYEKKPPKEFLERFKSLLQKMIHQHLSSRTHGSEDS

SEQ ID NO: 22 - skipped

SEQ ID NO: 23 - protein, 133 aa, Artificial Sequence
  Synthetic Polypeptide
  MISC_FEATURE (75)..(75): Xaa is any amino acid
QGQDRHMIRMRQLIDIVDQLKNYVNDLVPEFLPAPEDVETNCEWSAFSCFQKAQLKSANTGNNERIINVSIKKLXRKPPSTNAGRRQKHRLTCPSCDSYEKKPPKEFLERFKSLLQKMIHQHLSSRTHGSEDS

SEQ ID NO: 24 - protein, 133 aa, Artificial Sequence
  Synthetic Polypeptide
  MISC_FEATURE (76)..(76): Xaa is any amino acid
QGQDRHMIRMRQLIDIVDQLKNYVNDLVPEFLPAPEDVETNCEWSAFSCFQKAQLKSANTGNNERIINVSIKKLKXKPPSTNAGRRQKHRLTCPSCDSYEKKPPKEFLERFKSLLQKMIHQHLSSRTHGSEDS

SEQ ID NO: 25 - protein, 133 aa, Artificial Sequence
  Synthetic Polypeptide
  MISC_FEATURE (77)..(77): Xaa is any amino acid
QGQDRHMIRMRQLIDIVDQLKNYVNDLVPEFLPAPEDVETNCEWSAFSCFQKAQLKSANTGNNERIINVSIKKLKRXPPSTNAGRRQKHRLTCPSCDSYEKKPPKEFLERFKSLLQKMIHQHLSSRTHGSEDS

SEQ ID NO: 26 - protein, 133 aa, Artificial Sequence
  Synthetic Polypeptide
  MISC_FEATURE (78)..(78): Xaa is any amino acid
QGQDRHMIRMRQLIDIVDQLKNYVNDLVPEFLPAPEDVETNCEWSAFSCFQKAQLKSANTGNNERIINVSIKKLKRKXPSTNAGRRQKHRLTCPSCDSYEKKPPKEFLERFKSLLQKMIHQHLSSRTHGSEDS

SEQ ID NO: 27 - protein, 133 aa, Artificial Sequence
  Synthetic Polypeptide
  MISC_FEATURE (79)..(79): Xaa is any amino acid
QGQDRHMIRMRQLIDIVDQLKNYVNDLVPEFLPAPEDVETNCEWSAFSCFQKAQLKSANTGNNERIINVSIKKLKRKPXSTNAGRRQKHRLTCPSCDSYEKKPPKEFLERFKSLLQKMIHQHLSSRTHGSEDS

SEQ ID NO: 28 - protein, 133 aa, Artificial Sequence
  Synthetic Polypeptide
  MISC_FEATURE (80)..(80): Xaa is any amino acid
QGQDRHMIRMRQLIDIVDQLKNYVNDLVPEFLPAPEDVETNCEWSAFSCFQKAQLKSANTGNNERIINVSIKKLKRKPPXTNAGRRQKHRLTCPSCDSYEKKPPKEFLERFKSLLQKMIHQHLSSRTHGSEDS

SEQ ID NO: 29 - protein, 133 aa, Artificial Sequence
  Synthetic Polypeptide
  MISC_FEATURE (109)..(109): Xaa is any amino acid
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLXRFKSLLQKMIHQHLSSRTHGSEDS

SEQ ID NO: 30 - protein, 133 aa, Artificial Sequence
  Synthetic Polypeptide
  MISC_FEATURE (110)..(110): Xaa is any amino acid
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLEXFKSLLQKMIHQHLSSRTHGSEDS

SEQ ID NO: 31 - protein, 133 aa, Artificial Sequence
  Synthetic Polypeptide
  MISC_FEATURE (112)..(112): Xaa is any amino acid
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFXSLLQKMIHQHLSSRTHGSEDS

SEQ ID NO: 32 - protein, 133 aa, Artificial Sequence
  Synthetic Polypeptide
  MISC_FEATURE (113)..(113): Xaa is any amino acid
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKXLLQKMIHQHLSSRTHGSEDS

SEQ ID NO: 33 - protein, 133 aa, Artificial Sequence
  Synthetic Polypeptide
  MISC_FEATURE (116)..(116): Xaa is any amino acid
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLXKMIHQHLSSRTHGSEDS

SEQ ID NO: 34 - protein, 133 aa, Artificial Sequence
  Synthetic Polypeptide
  MISC_FEATURE (117)..(117): Xaa is any amino acid
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQXMIHQHLSSRTHGSEDS

SEQ ID NO: 35 - protein, 133 aa, Artificial Sequence
  Synthetic Polypeptide
  MISC_FEATURE (119)..(119): Xaa is any amino acid
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMXHQHLSSRTHGSEDS

SEQ ID NO: 36 - protein, 133 aa, Artificial Sequence
  Synthetic Polypeptide
  MISC_FEATURE (120)..(120): Xaa is any amino acid
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIXQHLSSRTHGSEDS

SEQ ID NO: 37 - protein, 133 aa, Artificial Sequence
  Synthetic Polypeptide
  MISC_FEATURE (123)..(123): Xaa is any amino acid
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHXSSRTHGSEDS

SEQ ID NO: 38 - protein, 133 aa, Artificial Sequence; identical to SEQ ID NO: 3
  Synthetic Polypeptide
  MISC_FEATURE (5)..(5): Xaa is A, D, E, G, H, I, K, L, M, N, Q, S, T, V or Y

SEQ ID NO: 39 - protein, 133 aa, Artificial Sequence; identical to SEQ ID NO: 4
  Synthetic Polypeptide
  MISC_FEATURE (8)..(8): Xaa is A, D, E, G, N, or S

SEQ ID NO: 40 - protein, 133 aa, Artificial Sequence; identical to SEQ ID NO: 5
  Synthetic Polypeptide
  MISC_FEATURE (9)..(9): Xaa is A, D, E, G, H, I K, L, M, N, Q, S, T, V or Y

SEQ ID NO: 41 - protein, 133 aa, Artificial Sequence; identical to SEQ ID NO: 6
  Synthetic Polypeptide
  MISC_FEATURE (11)..(11): Xaa is D or S

SEQ ID NO: 42 - protein, 133 aa, Artificial Sequence; identical to SEQ ID NO: 7
  Synthetic Polypeptide
  MISC_FEATURE (12)..(12): Xaa is A, D, E, N, S, T, or V

SEQ ID NO: 43 - protein, 133 aa, Artificial Sequence
  Synthetic Polypeptide
QGQDRHMIRMRQDIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 44 - protein, 133 aa, Artificial Sequence; identical to SEQ ID NO: 9
  Synthetic Polypeptide
  MISC_FEATURE (14)..(14): Xaa is A, D or S

SEQ ID NO: 45 - protein, 133 aa, Artificial Sequence; identical to SEQ ID NO: 10
  Synthetic Polypeptide
  MISC_FEATURE (15)..(15): Xaa is A, E, I, M, N, Q, S, T, or  V

SEQ ID NO: 46 - protein, 133 aa, Artificial Sequence; identical to SEQ ID NO: 11
  Synthetic Polypeptide
  MISC_FEATURE (16)..(16): Xaa is D or E

SEQ ID NO: 47 - protein, 133 aa, Artificial Sequence
  Synthetic Polypeptide
QGQDRHMIRMRQLIDIVDDLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 48 - protein, 133 aa, Artificial Sequence
  Synthetic Polypeptide
QGQDRHMIRMRQLIDIVDQLKNDVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 49 - protein, 133 aa, Artificial Sequence; identical to SEQ ID NO: 14
  Synthetic Polypeptide
  MISC_FEATURE (65)..(65): Xaa is D, G, or P

SEQ ID NO: 50 - protein, 133 aa, Artificial Sequence; identical to SEQ ID NO: 15
  Synthetic Polypeptide
  MISC_FEATURE (66)..(66): Xaa is D, G, or P

SEQ ID NO: 51 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIIQVSIKKLKRKPPSTNAGRRQKHRLTCPSCDSYEKKPPKEFLERFKSLLQKMIHQHLSSRTHGSEDS

SEQ ID NO: 52 - protein, 133 aa, Artificial Sequence; identical to SEQ ID NO: 17
  Synthetic Polypeptide
  MISC_FEATURE (69)..(69): Xaa is D, G, or P

SEQ ID NO: 53 - protein, 133 aa, Artificial Sequence; identical to SEQ ID NO: 18
  Synthetic Polypeptide
  MISC_FEATURE (70)..(70): Xaa is E, G, P, Y, or T

SEQ ID NO: 54 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSLKKLKRKPPSTNAGRRQKHRLTCPSCDSYEKKPPKEFLERFKSLLQKMIHQHLSSRTHGSEDS

SEQ ID NO: 55 - protein, 133 aa, Artificial Sequence; identical to SEQ ID NO: 20
  Synthetic Polypeptide
  MISC_FEATURE (72)..(72): Xaa is D, G, P, or A

SEQ ID NO: 56 - protein, 133 aa, Artificial Sequence; identical to SEQ ID NO: 21
  Synthetic Polypeptide
  MISC_FEATURE (73)..(73): Xaa is A, D, E, G, H, I, N, P, Q, S or V

SEQ ID NO: 57 - skipped

SEQ ID NO: 58 - protein, 133 aa, Artificial Sequence; identical to SEQ ID NO: 23
  Synthetic Polypeptide
  MISC_FEATURE (75)..(75): Xaa is D, G, or P

SEQ ID NO: 59 - protein, 133 aa, Artificial Sequence; identical to SEQ ID NO: 24
  Synthetic Polypeptide
  MISC_FEATURE (76)..(76): Xaa is A, D, E, G, H, I, K, L, M, N, P, Q, S, T, V, or  Y

SEQ ID NO: 60 - protein, 133 aa, Artificial Sequence; identical to SEQ ID NO: 25
  Synthetic Polypeptide
  MISC_FEATURE (77)..(77): Xaa is D, G, or P

SEQ ID NO: 61 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKDPSTNAGRRQKHRLTCPSCDSYEKKPPKEFLERFKSLLQKMIHQHLSSRTHGSEDS

SEQ ID NO: 62 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPDSTNAGRRQKHRLTCPSCDSYEKKPPKEFLERFKSLLQKMIHQHLSSRTHGSEDS

SEQ ID NO: 63 - protein, 133 aa, Artificial Sequence; identical to SEQ ID NO: 28
  Synthetic Polypeptide
  MISC_FEATURE (80)..(80): Xaa is G or P

SEQ ID NO: 64 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLKRFKSLLQKMIHQHLSSRTHGSEDS

SEQ ID NO: 65 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLEDFKSLLQKMIHQHLSSRTHGSEDS

SEQ ID NO: 66 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFDSLLQKMIHQHLSSRTHGSEDS

SEQ ID NO: 67 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKKLLQKMIHQHLSSRTHGSEDS

SEQ ID NO: 68 - protein, 133 aa, Artificial Sequence; identical to SEQ ID NO: 33
  Synthetic Polypeptide
  MISC_FEATURE (116)..(116): Xaa is A, D, E, I, K, L, M, N, S, T or V

SEQ ID NO: 69 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQDMIHQHLSSRTHGSEDS

SEQ ID NO: 70 - protein, 133 aa, Artificial Sequence; identical to SEQ ID NO: 35
  Synthetic Polypeptide
  MISC_FEATURE (119)..(119): Xaa is A, D, E, M, N, Q, S or T

SEQ ID NO: 71 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIDQHLSSRTHGSEDS

SEQ ID NO: 72 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHDSSRTHGSEDS

SEQ ID NO: 73 - protein, 133 aa, Artificial Sequence
  Synthetic Polypeptide
QGQDAHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 74 - protein, 133 aa, Artificial Sequence
  Synthetic Polypeptide
QGQDDHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 75 - protein, 133 aa, Artificial Sequence
  Synthetic Polypeptide
QGQDEHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 76 - protein, 133 aa, Artificial Sequence
  Synthetic Polypeptide
QGQDGHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 77 - protein, 133 aa, Artificial Sequence
  Synthetic Polypeptide
QGQDHHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 78 - protein, 133 aa, Artificial Sequence
  Synthetic Polypeptide
QGQDIHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 79 - protein, 133 aa, Artificial Sequence
  Synthetic Polypeptide
QGQDKHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 80 - protein, 133 aa, Artificial Sequence
  Synthetic Polypeptide
QGQDLHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 81 - protein, 133 aa, Artificial Sequence
  Synthetic Polypeptide
QGQDMHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 82 - protein, 133 aa, Artificial Sequence
  Synthetic Polypeptide
QGQDNHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 83 - protein, 133 aa, Artificial Sequence
  Synthetic Polypeptide
QGQDQHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 84 - protein, 133 aa, Artificial Sequence
  Synthetic Polypeptide
QGQDSHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 85 - protein, 133 aa, Artificial Sequence
  Synthetic Polypeptide
QGQDTHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 86 - protein, 133 aa, Artificial Sequence
  Synthetic Polypeptide
QGQDVHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 87 - protein, 133 aa, Artificial Sequence
  Synthetic Polypeptide
QGQDYHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 88 - protein, 133 aa, Artificial Sequence
  Synthetic Polypeptide
QGQDRHMARMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 89 - protein, 133 aa, Artificial Sequence
  Synthetic Polypeptide
QGQDRHMDRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 90 - protein, 133 aa, Artificial Sequence
  Synthetic Polypeptide
QGQDRHMERMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 91 - protein, 133 aa, Artificial Sequence
  Synthetic Polypeptide
QGQDRHMGRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 92 - protein, 133 aa, Artificial Sequence
  Synthetic Polypeptide
QGQDRHMNRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 93 - protein, 133 aa, Artificial Sequence
  Synthetic Polypeptide
QGQDRHMSRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 94 - protein, 133 aa, Artificial Sequence
  Synthetic Polypeptide
QGQDRHMIAMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 95 - protein, 133 aa, Artificial Sequence
  Synthetic Polypeptide
QGQDRHMIDMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 96 - protein, 133 aa, Artificial Sequence
  Synthetic Polypeptide
QGQDRHMIEMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 97 - protein, 133 aa, Artificial Sequence
  Synthetic Polypeptide
QGQDRHMIGMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 98 - protein, 133 aa, Artificial Sequence
  Synthetic Polypeptide
QGQDRHMIHMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 99 - protein, 133 aa, Artificial Sequence
  Synthetic Polypeptide
QGQDRHMIIMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 100 - protein, 133 aa, Artificial Sequence
  Synthetic Polypeptide
QGQDRHMIKMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 101 - protein, 133 aa, Artificial Sequence
  Synthetic Polypeptide
QGQDRHMILMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 102 - protein, 133 aa, Artificial Sequence
  Synthetic Polypeptide
QGQDRHMIMMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 103 - protein, 133 aa, Artificial Sequence
  Synthetic Polypeptide
QGQDRHMINMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 104 - protein, 133 aa, Artificial Sequence
  Synthetic Polypeptide
QGQDRHMIQMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 105 - protein, 133 aa, Artificial Sequence
  Synthetic Polypeptide
QGQDRHMISMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 106 - protein, 133 aa, Artificial Sequence
  Synthetic Polypeptide
QGQDRHMITMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 107 - protein, 133 aa, Artificial Sequence
  Synthetic Polypeptide
QGQDRHMIVMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 108 - protein, 133 aa, Artificial Sequence
  Synthetic Polypeptide
QGQDRHMIYMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 109 - protein, 133 aa, Artificial Sequence
  Synthetic Polypeptide
QGQDRHMIRMDQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 110 - protein, 133 aa, Artificial Sequence
  Synthetic Polypeptide
QGQDRHMIRMSQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 111 - protein, 133 aa, Artificial Sequence
  Synthetic Polypeptide
QGQDRHMIRMRALIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 112 - protein, 133 aa, Artificial Sequence; identical to SEQ ID NO: 43
  Synthetic Polypeptide

SEQ ID NO: 113 - skipped

SEQ ID NO: 114 - protein, 133 aa, Artificial Sequence
  Synthetic Polypeptide
QGQDRHMIRMRQLADIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 115 - protein, 133 aa, Artificial Sequence
  Synthetic Polypeptide
QGQDRHMIRMRQLDDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 116 - protein, 133 aa, Artificial Sequence
  Synthetic Polypeptide
QGQDRHMIRMRQLSDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 117 - protein, 133 aa, Artificial Sequence
  Synthetic Polypeptide
QGQDRHMIRMRQLIAIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 118 - protein, 133 aa, Artificial Sequence
  Synthetic Polypeptide
QGQDRHMIRMRQLIEIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 119 - protein, 133 aa, Artificial Sequence
  Synthetic Polypeptide
QGQDRHMIRMRQLIIIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 120 - protein, 133 aa, Artificial Sequence
  Synthetic Polypeptide
QGQDRHMIRMRQLIMIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 121 - protein, 133 aa, Artificial Sequence
  Synthetic Polypeptide
QGQDRHMIRMRQLINIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 122 - protein, 133 aa, Artificial Sequence
  Synthetic Polypeptide
QGQDRHMIRMRQLIQIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 123 - protein, 133 aa, Artificial Sequence
  Synthetic Polypeptide
QGQDRHMIRMRQLISIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 124 - protein, 133 aa, Artificial Sequence
  Synthetic Polypeptide
QGQDRHMIRMRQLIVIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 125 - protein, 133 aa, Artificial Sequence
  Synthetic Polypeptide
QGQDRHMIRMRQLIDDVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 126 - protein, 133 aa, Artificial Sequence
  Synthetic Polypeptide
QGQDRHMIRMRQLIDEVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 127 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNEDIINVSIKKLKRKPPSTNAGRRQKHRLTCPSCDSYEKKPPKEFLERFKSLLQKMIHQHLSSRTHGSEDS

SEQ ID NO: 128 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNEGIINVSIKKLKRKPPSTNAGRRQKHRLTCPSCDSYEKKPPKEFLERFKSLLQKMIHQHLSSRTHGSEDS

SEQ ID NO: 129 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNEPIINVSIKKLKRKPPSTNAGRRQKHRLTCPSCDSYEKKPPKEFLERFKSLLQKMIHQHLSSRTHGSEDS

SEQ ID NO: 130 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERDINVSIKKLKRKPPSTNAGRRQKHRLTCPSCDSYEKKPPKEFLERFKSLLQKMIHQHLSSRTHGSEDS

SEQ ID NO: 131 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERGINVSIKKLKRKPPSTNAGRRQKHRLTCPSCDSYEKKPPKEFLERFKSLLQKMIHQHLSSRTHGSEDS

SEQ ID NO: 132 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERPINVSIKKLKRKPPSTNAGRRQKHRLTCPSCDSYEKKPPKEFLERFKSLLQKMIHQHLSSRTHGSEDS

SEQ ID NO: 133 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINDSIKKLKRKPPSTNAGRRQKHRLTCPSCDSYEKKPPKEFLERFKSLLQKMIHQHLSSRTHGSEDS

SEQ ID NO: 134 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINGSIKKLKRKPPSTNAGRRQKHRLTCPSCDSYEKKPPKEFLERFKSLLQKMIHQHLSSRTHGSEDS

SEQ ID NO: 135 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINPSIKKLKRKPPSTNAGRRQKHRLTCPSCDSYEKKPPKEFLERFKSLLQKMIHQHLSSRTHGSEDS

SEQ ID NO: 136 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVEIKKLKRKPPSTNAGRRQKHRLTCPSCDSYEKKPPKEFLERFKSLLQKMIHQHLSSRTHGSEDS

SEQ ID NO: 137 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVGIKKLKRKPPSTNAGRRQKHRLTCPSCDSYEKKPPKEFLERFKSLLQKMIHQHLSSRTHGSEDS

SEQ ID NO: 138 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVPIKKLKRKPPSTNAGRRQKHRLTCPSCDSYEKKPPKEFLERFKSLLQKMIHQHLSSRTHGSEDS

SEQ ID NO: 139 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVYIKKLKRKPPSTNAGRRQKHRLTCPSCDSYEKKPPKEFLERFKSLLQKMIHQHLSSRTHGSEDS

SEQ ID NO: 140 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVTIKKLKRKPPSTNAGRRQKHRLTCPSCDSYEKKPPKEFLERFKSLLQKMIHQHLSSRTHGSEDS

SEQ ID NO: 141 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIDKLKRKPPSTNAGRRQKHRLTCPSCDSYEKKPPKEFLERFKSLLQKMIHQHLSSRTHGSEDS

SEQ ID NO: 142 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIGKLKRKPPSTNAGRRQKHRLTCPSCDSYEKKPPKEFLERFKSLLQKMIHQHLSSRTHGSEDS

SEQ ID NO: 143 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIPKLKRKPPSTNAGRRQKHRLTCPSCDSYEKKPPKEFLERFKSLLQKMIHQHLSSRTHGSEDS

SEQ ID NO: 144 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIAKLKRKPPSTNAGRRQKHRLTCPSCDSYEKKPPKEFLERFKSLLQKMIHQHLSSRTHGSEDS

SEQ ID NO: 145 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKALKRKPPSTNAGRRQKHRLTCPSCDSYEKKPPKEFLERFKSLLQKMIHQHLSSRTHGSEDS

SEQ ID NO: 146 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKDLKRKPPSTNAGRRQKHRLTCPSCDSYEKKPPKEFLERFKSLLQKMIHQHLSSRTHGSEDS

SEQ ID NO: 147 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKELKRKPPSTNAGRRQKHRLTCPSCDSYEKKPPKEFLERFKSLLQKMIHQHLSSRTHGSEDS

SEQ ID NO: 148 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKGLKRKPPSTNAGRRQKHRLTCPSCDSYEKKPPKEFLERFKSLLQKMIHQHLSSRTHGSEDS

SEQ ID NO: 149 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKHLKRKPPSTNAGRRQKHRLTCPSCDSYEKKPPKEFLERFKSLLQKMIHQHLSSRTHGSEDS

SEQ ID NO: 150 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKILKRKPPSTNAGRRQKHRLTCPSCDSYEKKPPKEFLERFKSLLQKMIHQHLSSRTHGSEDS

SEQ ID NO: 151 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKNLKRKPPSTNAGRRQKHRLTCPSCDSYEKKPPKEFLERFKSLLQKMIHQHLSSRTHGSEDS

SEQ ID NO: 152 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKPLKRKPPSTNAGRRQKHRLTCPSCDSYEKKPPKEFLERFKSLLQKMIHQHLSSRTHGSEDS

SEQ ID NO: 153 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKQLKRKPPSTNAGRRQKHRLTCPSCDSYEKKPPKEFLERFKSLLQKMIHQHLSSRTHGSEDS

SEQ ID NO: 154 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKSLKRKPPSTNAGRRQKHRLTCPSCDSYEKKPPKEFLERFKSLLQKMIHQHLSSRTHGSEDS

SEQ ID NO: 155 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKVLKRKPPSTNAGRRQKHRLTCPSCDSYEKKPPKEFLERFKSLLQKMIHQHLSSRTHGSEDS

SEQ ID NO: 156 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLDRKPPSTNAGRRQKHRLTCPSCDSYEKKPPKEFLERFKSLLQKMIHQHLSSRTHGSEDS

SEQ ID NO: 157 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLGRKPPSTNAGRRQKHRLTCPSCDSYEKKPPKEFLERFKSLLQKMIHQHLSSRTHGSEDS

SEQ ID NO: 158 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLPRKPPSTNAGRRQKHRLTCPSCDSYEKKPPKEFLERFKSLLQKMIHQHLSSRTHGSEDS

SEQ ID NO: 159 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 160 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKDKPPSTNAGRRQKHRLTCPSCDSYEKKPPKEFLERFKSLLQKMIHQHLSSRTHGSEDS

SEQ ID NO: 161 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 162 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKGKPPSTNAGRRQKHRLTCPSCDSYEKKPPKEFLERFKSLLQKMIHQHLSSRTHGSEDS

SEQ ID NO: 163 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKHKPPSTNAGRRQKHRLTCPSCDSYEKKPPKEFLERFKSLLQKMIHQHLSSRTHGSEDS

SEQ ID NO: 164 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKIKPPSTNAGRRQKHRLTCPSCDSYEKKPPKEFLERFKSLLQKMIHQHLSSRTHGSEDS

SEQ ID NO: 165 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKKKPPSTNAGRRQKHRLTCPSCDSYEKKPPKEFLERFKSLLQKMIHQHLSSRTHGSEDS

SEQ ID NO: 166 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKLKPPSTNAGRRQKHRLTCPSCDSYEKKPPKEFLERFKSLLQKMIHQHLSSRTHGSEDS

SEQ ID NO: 167 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKMKPPSTNAGRRQKHRLTCPSCDSYEKKPPKEFLERFKSLLQKMIHQHLSSRTHGSEDS

SEQ ID NO: 168 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKNKPPSTNAGRRQKHRLTCPSCDSYEKKPPKEFLERFKSLLQKMIHQHLSSRTHGSEDS

SEQ ID NO: 169 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKPKPPSTNAGRRQKHRLTCPSCDSYEKKPPKEFLERFKSLLQKMIHQHLSSRTHGSEDS

SEQ ID NO: 170 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKQKPPSTNAGRRQKHRLTCPSCDSYEKKPPKEFLERFKSLLQKMIHQHLSSRTHGSEDS

SEQ ID NO: 171 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKSKPPSTNAGRRQKHRLTCPSCDSYEKKPPKEFLERFKSLLQKMIHQHLSSRTHGSEDS

SEQ ID NO: 172 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKTKPPSTNAGRRQKHRLTCPSCDSYEKKPPKEFLERFKSLLQKMIHQHLSSRTHGSEDS

SEQ ID NO: 173 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKVKPPSTNAGRRQKHRLTCPSCDSYEKKPPKEFLERFKSLLQKMIHQHLSSRTHGSEDS

SEQ ID NO: 174 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKYKPPSTNAGRRQKHRLTCPSCDSYEKKPPKEFLERFKSLLQKMIHQHLSSRTHGSEDS

SEQ ID NO: 175 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRDPPSTNAGRRQKHRLTCPSCDSYEKKPPKEFLERFKSLLQKMIHQHLSSRTHGSEDS

SEQ ID NO: 176 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRGPPSTNAGRRQKHRLTCPSCDSYEKKPPKEFLERFKSLLQKMIHQHLSSRTHGSEDS

SEQ ID NO: 177 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRPPPSTNAGRRQKHRLTCPSCDSYEKKPPKEFLERFKSLLQKMIHQHLSSRTHGSEDS

SEQ ID NO: 178 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPGTNAGRRQKHRLTCPSCDSYEKKPPKEFLERFKSLLQKMIHQHLSSRTHGSEDS

SEQ ID NO: 179 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPPTNAGRRQKHRLTCPSCDSYEKKPPKEFLERFKSLLQKMIHQHLSSRTHGSEDS

SEQ ID NO: 180 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLAKMIHQHLSSRTHGSEDS

SEQ ID NO: 181 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLDKMIHQHLSSRTHGSEDS

SEQ ID NO: 182 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLEKMIHQHLSSRTHGSEDS

SEQ ID NO: 183 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLIKMIHQHLSSRTHGSEDS

SEQ ID NO: 184 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLKKMIHQHLSSRTHGSEDS

SEQ ID NO: 185 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLLKMIHQHLSSRTHGSEDS

SEQ ID NO: 186 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLMKMIHQHLSSRTHGSEDS

SEQ ID NO: 187 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLNKMIHQHLSSRTHGSEDS

SEQ ID NO: 188 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLSKMIHQHLSSRTHGSEDS

SEQ ID NO: 189 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLTKMIHQHLSSRTHGSEDS

SEQ ID NO: 190 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLVKMIHQHLSSRTHGSEDS

SEQ ID NO: 191 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMAHQHLSSRTHGSEDS

SEQ ID NO: 192 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMDHQHLSSRTHGSEDS

SEQ ID NO: 193 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMEHQHLSSRTHGSEDS

SEQ ID NO: 194 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMMHQHLSSRTHGSEDS

SEQ ID NO: 195 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMNHQHLSSRTHGSEDS

SEQ ID NO: 196 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMQHQHLSSRTHGSEDS

SEQ ID NO: 197 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMSHQHLSSRTHGSEDS

SEQ ID NO: 198 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMTHQHLSSRTHGSEDS

SEQ ID NO: 199 - protein, 133 aa, Artificial Sequence
  Synthetic Polypeptide
  MISC_FEATURE (15)..(15): Xaa is any amino acid
  MISC_FEATURE (70)..(70): Xaa is any amino acid
QGQDRHMIRMRQLIXIVDQLKNYVNDLVPEFLPAPEDVETNCEWSAFSCFQKAQLKSANTGNNERIINVXIKKLKRKPPSTNAGRRQKHRLTCPSCDSYEKKPPKEFLERFKSLLQKMIHQHLSSRTHGSEDS

SEQ ID NO: 200 - protein, 133 aa, Artificial Sequence
  Synthetic Polypeptide
  MISC_FEATURE (15)..(15): Xaa is any amino acid
  MISC_FEATURE (71)..(71): Xaa is any amino acid
QGQDRHMIRMRQLIXIVDQLKNYVNDLVPEFLPAPEDVETNCEWSAFSCFQKAQLKSANTGNNERIINVSXKKLKRKPPSTNAGRRQKHRLTCPSCDSYEKKPPKEFLERFKSLLQKMIHQHLSSRTHGSEDS

SEQ ID NO: 201 - protein, 133 aa, Artificial Sequence
  Synthetic Polypeptide
  MISC_FEATURE (15)..(15): Xaa is any amino acid
  MISC_FEATURE (72)..(72): Xaa is any amino acid
QGQDRHMIRMRQLIXIVDQLKNYVNDLVPEFLPAPEDVETNCEWSAFSCFQKAQLKSANTGNNERIINVSIXKLKRKPPSTNAGRRQKHRLTCPSCDSYEKKPPKEFLERFKSLLQKMIHQHLSSRTHGSEDS

SEQ ID NO: 202 - protein, 133 aa, Artificial Sequence
  Synthetic Polypeptide
  MISC_FEATURE (15)..(15): Xaa is any amino acid
  MISC_FEATURE (73)..(73): Xaa is any amino acid
QGQDRHMIRMRQLIXIVDQLKNYVNDLVPEFLPAPEDVETNCEWSAFSCFQKAQLKSANTGNNERIINVSIKXLKRKPPSTNAGRRQKHRLTCPSCDSYEKKPPKEFLERFKSLLQKMIHQHLSSRTHGSEDS

SEQ ID NO: 203 - protein, 133 aa, Artificial Sequence
  Synthetic Polypeptide
  MISC_FEATURE (71)..(71): Xaa is any amino acid
  MISC_FEATURE (73)..(73): Xaa is any amino acid
QGQDRHMIRMRQLIDIVDQLKNYVNDLVPEFLPAPEDVETNCEWSAFSCFQKAQLKSANTGNNERIINVSXKXLKRKPPSTNAGRRQKHRLTCPSCDSYEKKPPKEFLERFKSLLQKMIHQHLSSRTHGSEDS

SEQ ID NO: 204 - protein, 133 aa, Artificial Sequence
  Synthetic Polypeptide
  MISC_FEATURE (72)..(73): Xaa is any amino acid
QGQDRHMIRMRQLIDIVDQLKNYVNDLVPEFLPAPEDVETNCEWSAFSCFQKAQLKSANTGNNERIINVSIXXLKRKPPSTNAGRRQKHRLTCPSCDSYEKKPPKEFLERFKSLLQKMIHQHLSSRTHGSEDS

SEQ ID NO: 205 - protein, 133 aa, Artificial Sequence
  Synthetic Polypeptide
  MISC_FEATURE (70)..(70): Xaa is any amino acid
  MISC_FEATURE (73)..(73): Xaa is any amino acid
QGQDRHMIRMRQLIDIVDQLKNYVNDLVPEFLPAPEDVETNCEWSAFSCFQKAQLKSANTGNNERIINVXIKXLKRKPPSTNAGRRQKHRLTCPSCDSYEKKPPKEFLERFKSLLQKMIHQHLSSRTHGSEDS

SEQ ID NO: 206 - protein, 133 aa, Artificial Sequence
  Synthetic Polypeptide
  MISC_FEATURE (71)..(71): Xaa is any amino acid
  MISC_FEATURE (76)..(76): Xaa is any amino acid
QGQDRHMIRMRQLIDIVDQLKNYVNDLVPEFLPAPEDVETNCEWSAFSCFQKAQLKSANTGNNERIINVSXKKLKXKPPSTNAGRRQKHRLTCPSCDSYEKKPPKEFLERFKSLLQKMIHQHLSSRTHGSEDS

SEQ ID NO: 207 - protein, 133 aa, Artificial Sequence
  Synthetic Polypeptide
  MISC_FEATURE (72)..(72): Xaa is any amino acid
  MISC_FEATURE (76)..(76): Xaa is any amino acid
QGQDRHMIRMRQLIDIVDQLKNYVNDLVPEFLPAPEDVETNCEWSAFSCFQKAQLKSANTGNNERIINVSIXKLKXKPPSTNAGRRQKHRLTCPSCDSYEKKPPKEFLERFKSLLQKMIHQHLSSRTHGSEDS

SEQ ID NO: 208 - protein, 133 aa, Artificial Sequence
  Synthetic Polypeptide
  MISC_FEATURE (73)..(73): Xaa is any amino acid
  MISC_FEATURE (76)..(76): Xaa is any amino acid
QGQDRHMIRMRQLIDIVDQLKNYVNDLVPEFLPAPEDVETNCEWSAFSCFQKAQLKSANTGNNERIINVSIKXLKXKPPSTNAGRRQKHRLTCPSCDSYEKKPPKEFLERFKSLLQKMIHQHLSSRTHGSEDS

SEQ ID NO: 209 - skipped

SEQ ID NO: 210 - protein, 133 aa, Artificial Sequence
  Synthetic Polypeptide
  MISC_FEATURE (5)..(5): Xaa is any amino acid
  MISC_FEATURE (76)..(76): Xaa is any amino acid
QGQDXHMIRMRQLIDIVDQLKNYVNDLVPEFLPAPEDVETNCEWSAFSCFQKAQLKSANTGNNERIINVSIKKLKXKPPSTNAGRRQKHRLTCPSCDSYEKKPPKEFLERFKSLLQKMIHQHLSSRTHGSEDS

SEQ ID NO: 211 - protein, 133 aa, Artificial Sequence
  Synthetic Polypeptide
  MISC_FEATURE (9)..(9): Xaa is any amino acid
  MISC_FEATURE (76)..(76): Xaa is any amino acid
QGQDRHMIXMRQLIDIVDQLKNYVNDLVPEFLPAPEDVETNCEWSAFSCFQKAQLKSANTGNNERIINVSIKKLKXKPPSTNAGRRQKHRLTCPSCDSYEKKPPKEFLERFKSLLQKMIHQHLSSRTHGSEDS

SEQ ID NO: 212 - protein, 133 aa, Artificial Sequence
  Synthetic Polypeptide
  MISC_FEATURE (70)..(70): Xaa is any amino acid
  MISC_FEATURE (76)..(76): Xaa is any amino acid
QGQDRHMIRMRQLIDIVDQLKNYVNDLVPEFLPAPEDVETNCEWSAFSCFQKAQLKSANTGNNERIINVXIKKLKXKPPSTNAGRRQKHRLTCPSCDSYEKKPPKEFLERFKSLLQKMIHQHLSSRTHGSEDS

SEQ ID NO: 213 - protein, 133 aa, Artificial Sequence
  Synthetic Polypeptide
QGQDRHMIRMRQLINIVDQLKNYVNDLVPEFLPAPEDVETNCEWSAFSCFQKAQLKSANTGNNERIINVTIKKLKRKPPSTNAGRRQKHRLTCPSCDSYEKKPPKEFLERFKSLLQKMIHQHLSSRTHGSEDS

SEQ ID NO: 214 - protein, 133 aa, Artificial Sequence
  Synthetic Polypeptide
QGQDRHMIRMRQLINIVDQLKNYVNDLVPEFLPAPEDVETNCEWSAFSCFQKAQLKSANTGNNERIINVSLKKLKRKPPSTNAGRRQKHRLTCPSCDSYEKKPPKEFLERFKSLLQKMIHQHLSSRTHGSEDS

SEQ ID NO: 215 - protein, 133 aa, Artificial Sequence
  Synthetic Polypeptide
QGQDRHMIRMRQLINIVDQLKNYVNDLVPEFLPAPEDVETNCEWSAFSCFQKAQLKSANTGNNERIINVSIAKLKRKPPSTNAGRRQKHRLTCPSCDSYEKKPPKEFLERFKSLLQKMIHQHLSSRTHGSEDS

SEQ ID NO: 216 - protein, 133 aa, Artificial Sequence
  Synthetic Polypeptide
QGQDRHMIRMRQLINIVDQLKNYVNDLVPEFLPAPEDVETNCEWSAFSCFQKAQLKSANTGNNERIINVSIKALKRKPPSTNAGRRQKHRLTCPSCDSYEKKPPKEFLERFKSLLQKMIHQHLSSRTHGSEDS

SEQ ID NO: 217 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSLKQLKRKPPSTNAGRRQKHRLTCPSCDSYEKKPPKEFLERFKSLLQKMIHQHLSSRTHGSEDS

SEQ ID NO: 218 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIAQLKRKPPSTNAGRRQKHRLTCPSCDSYEKKPPKEFLERFKSLLQKMIHQHLSSRTHGSEDS

SEQ ID NO: 219 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVTIKQLKRKPPSTNAGRRQKHRLTCPSCDSYEKKPPKEFLERFKSLLQKMIHQHLSSRTHGSEDS

SEQ ID NO: 220 - protein, 133 aa, Artificial Sequence
  Synthetic Polypeptide
  MISC_FEATURE (76)..(76): Xaa is A, D, or E
QGQDRHMIRMRQLIDIVDQLKNYVNDLVPEFLPAPEDVETNCEWSAFSCFQKAQLKSANTGNNERIINVSLKKLKXKPPSTNAGRRQKHRLTCPSCDSYEKKPPKEFLERFKSLLQKMIHQHLSSRTHGSEDS

SEQ ID NO: 221 - protein, 133 aa, Artificial Sequence
  Synthetic Polypeptide
  MISC_FEATURE (76)..(76): Xaa is A, D, or E
QGQDRHMIRMRQLIDIVDQLKNYVNDLVPEFLPAPEDVETNCEWSAFSCFQKAQLKSANTGNNERIINVSIAKLKXKPPSTNAGRRQKHRLTCPSCDSYEKKPPKEFLERFKSLLQKMIHQHLSSRTHGSEDS

SEQ ID NO: 222 - protein, 133 aa, Artificial Sequence
  Synthetic Polypeptide
  MISC_FEATURE (76)..(76): Xaa is A, D, or E
QGQDRHMIRMRQLIDIVDQLKNYVNDLVPEFLPAPEDVETNCEWSAFSCFQKAQLKSANTGNNERIINVSIKALKXKPPSTNAGRRQKHRLTCPSCDSYEKKPPKEFLERFKSLLQKMIHQHLSSRTHGSEDS

SEQ ID NO: 223 - skipped

SEQ ID NO: 224 - protein, 133 aa, Artificial Sequence; identical to SEQ ID NO: 210
  Synthetic Polypeptide
  MISC_FEATURE (5)..(5): Xaa is A, E, or Q
  MISC_FEATURE (76)..(76): Xaa is A or E

SEQ ID NO: 225 - protein, 133 aa, Artificial Sequence; identical to SEQ ID NO: 211
  Synthetic Polypeptide
  MISC_FEATURE (9)..(9): Xaa is A or E
  MISC_FEATURE (76)..(76): Xaa is A or E

SEQ ID NO: 226 - protein, 133 aa, Artificial Sequence
  Synthetic Polypeptide
  MISC_FEATURE (76)..(76): Xaa is A, D, or E
QGQDRHMIRMRQLIDIVDQLKNYVNDLVPEFLPAPEDVETNCEWSAFSCFQKAQLKSANTGNNERIINVTIKKLKXKPPSTNAGRRQKHRLTCPSCDSYEKKPPKEFLERFKSLLQKMIHQHLSSRTHGSEDS

SEQ ID NO: 227 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSLKKLKAKPPSTNAGRRQKHRLTCPSCDSYEKKPPKEFLERFKSLLQKMIHQHLSSRTHGSEDS

SEQ ID NO: 228 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSLKKLKDKPPSTNAGRRQKHRLTCPSCDSYEKKPPKEFLERFKSLLQKMIHQHLSSRTHGSEDS

SEQ ID NO: 229 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSLKKLKEKPPSTNAGRRQKHRLTCPSCDSYEKKPPKEFLERFKSLLQKMIHQHLSSRTHGSEDS

SEQ ID NO: 230 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIAKLKAKPPSTNAGRRQKHRLTCPSCDSYEKKPPKEFLERFKSLLQKMIHQHLSSRTHGSEDS

SEQ ID NO: 231 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIAKLKDKPPSTNAGRRQKHRLTCPSCDSYEKKPPKEFLERFKSLLQKMIHQHLSSRTHGSEDS

SEQ ID NO: 232 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIAKLKEKPPSTNAGRRQKHRLTCPSCDSYEKKPPKEFLERFKSLLQKMIHQHLSSRTHGSEDS

SEQ ID NO: 233 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKALKAKPPSTNAGRRQKHRLTCPSCDSYEKKPPKEFLERFKSLLQKMIHQHLSSRTHGSEDS

SEQ ID NO: 234 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKALKDKPPSTNAGRRQKHRLTCPSCDSYEKKPPKEFLERFKSLLQKMIHQHLSSRTHGSEDS

SEQ ID NO: 235 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVSIKALKEKPPSTNAGRRQKHRLTCPSCDSYEKKPPKEFLERFKSLLQKMIHQHLSSRTHGSEDS

SEQ ID NO: 236 - protein, 133 aa, Artificial Sequence
  Synthetic Polypeptide
QGQDAHMIRMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 237 - protein, 133 aa, Artificial Sequence
  Synthetic Polypeptide
QGQDAHMIRMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 238 - protein, 133 aa, Artificial Sequence
  Synthetic Polypeptide
QGQDEHMIRMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 239 - protein, 133 aa, Artificial Sequence
  Synthetic Polypeptide
QGQDEHMIRMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 240 - protein, 133 aa, Artificial Sequence
  Synthetic Polypeptide
QGQDQHMIRMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 241 - protein, 133 aa, Artificial Sequence
  Synthetic Polypeptide
QGQDQHMIRMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 242 - protein, 133 aa, Artificial Sequence
  Synthetic Polypeptide
QGQDRHMIAMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 243 - protein, 133 aa, Artificial Sequence
  Synthetic Polypeptide
QGQDRHMIAMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 244 - protein, 133 aa, Artificial Sequence
  Synthetic Polypeptide
QGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 245 - protein, 133 aa, Artificial Sequence
  Synthetic Polypeptide
QGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 246 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVTIKKLKAKPPSTNAGRRQKHRLTCPSCDSYEKKPPKEFLERFKSLLQKMIHQHLSSRTHGSEDS

SEQ ID NO: 247 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVTIKKLKDKPPSTNAGRRQKHRLTCPSCDSYEKKPPKEFLERFKSLLQKMIHQHLSSRTHGSEDS

SEQ ID NO: 248 - protein, 133 aa, Artificial Sequence
  Synthetic Polypeptide
QGQDRHMIRMRQLIDIVDQLKNYVNDLVPEFLPAPEDVETNCEWSAFSCFQKAQLKSANTGNNERIINVTIKKLKEKPPSTNAGRRQKHRLTCPSCDSYEKKPPKEFLERFKSLLQKMIHQHLSSRTHGSEDS

SEQ ID NO: 249 - protein, 133 aa, Artificial Sequence
  Synthetic Polypeptide
QGQDRHMIRMRDLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 250 - protein, 133 aa, Artificial Sequence
  Synthetic Polypeptide
QGQDRHMIRMRELIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 251 - protein, 133 aa, Artificial Sequence
  Synthetic Polypeptide
QGQDRHMIRMRNLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 252 - protein, 133 aa, Artificial Sequence
  Synthetic Polypeptide
QGQDRHMIRMRSLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 253 - protein, 133 aa, Artificial Sequence
  Synthetic Polypeptide
QGQDRHMIRMRTLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 254 - protein, 133 aa, Artificial Sequence
  Synthetic Polypeptide
QGQDRHMIRMRVLIDIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 255 - protein, 133 aa, Artificial Sequence; identical to SEQ ID NO: 219
  Synthetic Polypeptide

SEQ ID NO: 256 - protein, 519 aa, Homo sapiens
CPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKEGWNPHLLLLLLLVIVFIPAFWSLKTHPLWRLWKKIWAVPSPERFFMPLYKGCSGDFKKWVGAPFTGSSLELGPWSPEVPSTLEVYSCHPPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 257 - protein, 347 aa, Artificial Sequence
  Synthetic Polypeptide
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 258 - protein, 160 aa, Homo sapiens
MRSSPGNMERIVICLMVIFLGTLVHKSSSQGQDRHMIRMRQLIDIVDQLKNYVNDLVPEFLPAPEDVETNEWSAFSCFQKAQLKSANTGNNERIINVSIKKLKRKPPSTNAGRRQKHRLTCPSCDSYEKKPPKEFLERFSLLQKMIHQHLSSRTHGSEDS

SEQ ID NO: 259 - protein, 152 aa, Homo sapiens
MRSSPGNMERIVICLMVIFLGTLVHKSSSQGQDRHMIRMRQLIDIVDQLKNYVNDLVPEFLPAPEDVETNEWSAFSCFQKAQLKSANTGNNERIINVSIKKLKRKPPSTNAGRRQKHRLTCPSCDSYEKKPPKEFLERFKSLLQKVSTLSFI

SEQ ID NO: 260 - protein, 29 aa, Homo sapiens
MRSSPGNMERIVICLMVIFLGTLVHKSSS

SEQ ID NO: 261 - protein, 519 aa, Homo sapiens; identical to SEQ ID NO: 256

SEQ ID NO: 262 - protein, 5 aa, Artificial Sequence
  Synthetic Polypeptide
GGGGS

SEQ ID NO: 263 - protein, 268 aa, Homo sapiens
PGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 264 - protein, 288 aa, Macaca fascicularis
MQIPQAPWPVVWAVLQLGWRPGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALVVGVVGGLLGSLVLLVWVLAVICSRAAQGTIEARRTGQPLKEDPSAVPVFSVDYGELDFQWREKTPEPPAPCVPEQTEYATIVFPSGLGTSSPARRGSADGPRSPRPLRPEDGHCSWPL

SEQ ID NO: 265 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 266 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 267 - protein, 334 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGS

SEQ ID NO: 268 - protein, 595 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGQGQDRHMIRMRQLIDIVDQLKNYVNDLVPEFLPAPEDVETNCEWSAFSCFQKAQLKSANTGNNERIINVSIKALKEKPPSTNAGRRQKHRLTCPSCDSYEKKPPKEFLERFKSLLQKMIHQHLSSRTHGSEDSQGQDAHMIRMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 269 - protein, 329 aa, Artificial Sequence; identical to SEQ ID NO: 266
  Synthetic Polypeptide

SEQ ID NO: 270 - protein, 462 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGQGQDEHMIRMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 271 - protein, 462 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGQGQDQHMIRMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 272 - protein, 462 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 273 - protein, 462 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGQGQDRHMIRMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 274 - protein, 462 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGQGQDRHMIRMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 275 - protein, 467 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSQGQDRHMIRMRQLIDIVDQLKNYVNDLVPEFLPAPEDVETNCEWSAFSCFQKAQLKSANTGNNERIINVSIKALKEKPPSTNAGRRQKHRLTCPSCDSYEKKPPKEFLERFKSLLQKMIHQHLSSRTHGSEDS

SEQ ID NO: 276 - protein, 467 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSQGQDAHMIRMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 277 - protein, 467 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSQGQDEHMIRMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 278 - protein, 467 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSQGQDQHMIRMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 279 - protein, 467 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 280 - protein, 467 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSQGQDRHMIRMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 281 - protein, 467 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSQGQDRHMIRMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 282 - protein, 335 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGS

SEQ ID NO: 283 - protein, 133 aa, Artificial Sequence
  Synthetic Polypeptide
QGQDRHMIRMRQLITIVDQLKNYVNDLVPEFLPAPEDVETNCEWSAFSCFQKAQLKSANTGNNERIINVSIKKLKRKPPSTNAGRRQKHRLTCPSCDSYEKKPPKEFLERFKSLLQKMIHQHLSSRTHGSEDS

SEQ ID NO: 284 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 285 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 286 - protein, 334 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGS

SEQ ID NO: 287 - protein, 335 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGS

SEQ ID NO: 288 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 289 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 290 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPG

SEQ ID NO: 291 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 292 - protein, 334 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGGGGGS

SEQ ID NO: 293 - protein, 334 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGS

SEQ ID NO: 294 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 295 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 296 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 297 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 298 - protein, 334 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGS

SEQ ID NO: 299 - protein, 334 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGS

SEQ ID NO: 300 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 301 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 302 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPG

SEQ ID NO: 303 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 304 - protein, 334 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGGGGGS

SEQ ID NO: 305 - protein, 334 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGS

SEQ ID NO: 306 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 307 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 308 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 309 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 310 - protein, 334 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGGGGGS

SEQ ID NO: 311 - protein, 334 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGS

SEQ ID NO: 312 - protein, 5 aa, Artificial Sequence
  Synthetic peptide
NYGMH

SEQ ID NO: 313 - protein, 17 aa, Artificial Sequence
  Synthetic peptide
LIWYDGSKKYYADSVKG

SEQ ID NO: 314 - protein, 16 aa, Artificial Sequence
  Synthetic peptide
DPSSLTGSTGYYGMDV

SEQ ID NO: 315 - protein, 11 aa, Artificial Sequence
  Synthetic peptide
SGDKLGDKYAC

SEQ ID NO: 316 - protein, 7 aa, Artificial Sequence
  Synthetic peptide
QDRKRPS

SEQ ID NO: 317 - protein, 9 aa, Artificial Sequence
  Synthetic peptide
QAWDSSTEV

SEQ ID NO: 318 - protein, 125 aa, Artificial Sequence
  Synthetic peptide
QVQLVESGGGVVQPGRSLRLSCAASGFTFSNYGMHWVRQAPGKGLEWVALIWYDGSKKYYADSVKGRFTISRDNSKNTLYLQMNSLRAEDTAAYYCARDPSSLTGSTGYYGMDVWGQGTTVTVSS

SEQ ID NO: 319 - protein, 106 aa, Artificial Sequence
  Synthetic peptide
SYELTQPPSVSVSPGQTASITCSGDKLGDKYACWYQQKPGQSPVLVIYQDRKRPSGIPERFSGSNSGNTATLTISGTQAMDEADYYCQAWDSSTEVFGGGTKLTVL

SEQ ID NO: 320 - protein, 477 aa, Artificial Sequence
  Synthetic peptide
MDMRVPAQLLGLLLLWLRGARCQVQLVESGGGVVQPGRSLRLSCAASGFTFSNYGMHWVRQAPGKGLEWVALIWYDGSKKYYADSVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 321 - protein, 231 aa, Artificial Sequence
  Synthetic peptide
MAWALLLLTLLTQGTGSWASYELTQPPSVSVSPGQTASITCSGDKLGDKYACWYQQKPGQSPVLVIYQDRKRPSGIPERFSGSNSGNTATLTISGTQAMDEADYYCQAWDSSTEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 322 - protein, 5 aa, Artificial Sequence
  Synthetic peptide
SYDMS

SEQ ID NO: 323 - protein, 17 aa, Artificial Sequence
  Synthetic peptide
LISGGGSNTYYADSVKG

SEQ ID NO: 324 - protein, 11 aa, Artificial Sequence
  Synthetic peptide
PSGHYFYAMDV

SEQ ID NO: 325 - protein, 11 aa, Artificial Sequence
  Synthetic peptide
RASQGISNWLA

SEQ ID NO: 326 - protein, 7 aa, Artificial Sequence
  Synthetic peptide
AASSLQS

SEQ ID NO: 327 - protein, 9 aa, Artificial Sequence
  Synthetic peptide
QQADSFPHT

SEQ ID NO: 328 - protein, 120 aa, Artificial Sequence
  Synthetic peptide
EVQLLESGGGLVQPGGALRLSCAASGFTFSSYDMSWVRQAPGKGLEWVSLISGGGSNTYYADSVKGRFTISRDNSKNTLYLQMNSLRAEDTAVYFCASPSGHYFYAMDVWGQGTTVTVSS

SEQ ID NO: 329 - protein, 107 aa, Artificial Sequence
  Synthetic peptide
DIQMTQSPSSVSASVGDRVTITCRASQGISNWLAWYQQKPGKAPKLLIFAASSLQSGVPSRFGGSGSGTDFTFTISSLQPEDFATYYCQQADSFPHTFGGGTKVEIK

SEQ ID NO: 330 - protein, 472 aa, Artificial Sequence
  Synthetic peptide
MDMRVPAQLLGLLLLWLRGARCEVQLLESGGGLVQPGGALRLSCAASGFTFSSYDMSWVRQAPGKGLEWVSLISGGGSNTYYADSVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 331 - protein, 236 aa, Artificial Sequence
  Synthetic peptide
MDMRVPAQLLGLLLLWLRGARCDIQMTQSPSSVSASVGDRVTITCRASQGISNWLAWYQQKPGKAPKLLIFAASSLQSGVPSRFGGSGSGTDFTFTISSLQPEDFATYYCQQADSFPHTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 332 - protein, 5 aa, Artificial Sequence
  Synthetic peptide
DYSMS

SEQ ID NO: 333 - protein, 17 aa, Artificial Sequence
  Synthetic peptide
GINWNGGRTRYADSVKG

SEQ ID NO: 334 - protein, 12 aa, Artificial Sequence
  Synthetic peptide
EFNNFESNWFDP

SEQ ID NO: 335 - protein, 11 aa, Artificial Sequence
  Synthetic peptide
SGDALPKKYAY

SEQ ID NO: 336 - protein, 7 aa, Artificial Sequence
  Synthetic peptide
EDSKRPS

SEQ ID NO: 337 - protein, 11 aa, Artificial Sequence
  Synthetic peptide
YSTDSSGNHRV

SEQ ID NO: 338 - protein, 121 aa, Artificial Sequence
  Synthetic peptide
EVQLVESGGSVVRPGGSLRLSCAASGFTVDDYSMSWVRQVPGKGLEWVSGINWNGGRTRYADSVKGRFTISRDSAKNSLYLQMNSLRAEDTALYYCAREFNNFESNWFDPWGQGTLVTVSS

SEQ ID NO: 339 - protein, 108 aa, Artificial Sequence
  Synthetic peptide
SYELTQPPSVSVSPGQTARITCSGDALPKKYAYWYQQKSGQAPVLVISEDSKRPSGIPERFSGSSSGTMATLTISGAQVEDEADYYCYSTDSSGNHRVFGGGTKLTVL

SEQ ID NO: 340 - protein, 473 aa, Artificial Sequence
  Synthetic peptide
MDMRVPAQLLGLLLLWLRGARCEVQLVESGGSVVRPGGSLRLSCAASGFTVDDYSMSWVRQVPGKGLEWVSGINWNGGRTRYADSVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 341 - protein, 233 aa, Artificial Sequence
  Synthetic peptide
MAWALLLLTLLTQGTGSWASYELTQPPSVSVSPGQTARITCSGDALPKKYAYWYQQKSGQAPVLVISEDSKRPSGIPERFSGSSSGTMATLTISGAQVEDEADYYCYSTDSSGNHRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 342 - protein, 5 aa, Artificial Sequence
  Synthetic peptide
SYDMS

SEQ ID NO: 343 - protein, 17 aa, Artificial Sequence
  Synthetic peptide
LISGGGSNTYYAESVKG

SEQ ID NO: 344 - protein, 11 aa, Artificial Sequence
  Synthetic peptide
PSGHYFYAMDV

SEQ ID NO: 345 - protein, 11 aa, Artificial Sequence
  Synthetic peptide
RASQGISNWLA

SEQ ID NO: 346 - protein, 7 aa, Artificial Sequence
  Synthetic peptide
AASSLQS

SEQ ID NO: 347 - protein, 9 aa, Artificial Sequence
  Synthetic peptide
QQAESFPHT

SEQ ID NO: 348 - protein, 120 aa, Artificial Sequence
  Synthetic peptide
EVQLLESGGGLVQPGGSLRLSCAASGFTFSSYDMSWVRQAPGKGLEWVSLISGGGSNTYYAESVKGRFTISRDNSKNTLYLQMNSLRAEDTAVYFCASPSGHYFYAMDVWGQGTTVTVSS

SEQ ID NO: 349 - protein, 107 aa, Artificial Sequence
  Synthetic peptide
DIQMTQSPSSVSASVGDRVTITCRASQGISNWLAWYQQKPGKAPKLLIFAASSLQSGVPSRFSGSGSGTDFTLTISSLQPEDFATYYCQQAESFPHTFGGGTKVEIK

SEQ ID NO: 350 - protein, 472 aa, Artificial Sequence
  Synthetic peptide
MDMRVPAQLLGLLLLWLRGARCEVQLLESGGGLVQPGGSLRLSCAASGFTFSSYDMSWVRQAPGKGLEWVSLISGGGSNTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 351 - protein, 236 aa, Artificial Sequence
  Synthetic peptide
MDMRVPAQLLGLLLLWLRGARCDIQMTQSPSSVSASVGDRVTITCRASQGISNWLAWYQQKPGKAPKLLIFAASSLQSGVPSRFSGSGSGTDFTLTISSLQPEDFATYYCQQAESFPHTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 352 - protein, 5 aa, Artificial Sequence
  Synthetic peptide
SYDMS

SEQ ID NO: 353 - protein, 17 aa, Artificial Sequence
  Synthetic peptide
LISGGGSQTYYAESVKG

SEQ ID NO: 354 - protein, 11 aa, Artificial Sequence
  Synthetic peptide
PSGHYFYAMDV

SEQ ID NO: 355 - protein, 11 aa, Artificial Sequence
  Synthetic peptide
RASQGISNWLA

SEQ ID NO: 356 - protein, 7 aa, Artificial Sequence
  Synthetic peptide
AASSLQS

SEQ ID NO: 357 - protein, 9 aa, Artificial Sequence
  Synthetic peptide
QQAESFPHT

SEQ ID NO: 358 - protein, 120 aa, Artificial Sequence
  Synthetic peptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSS

SEQ ID NO: 359 - protein, 107 aa, Artificial Sequence; identical to SEQ ID NO: 349
  Synthetic peptide

SEQ ID NO: 360 - protein, 472 aa, Artificial Sequence
  Synthetic peptide
MDMRVPAQLLGLLLLWLRGARCEVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 361 - protein, 236 aa, Artificial Sequence; identical to SEQ ID NO: 351
  Synthetic peptide

SEQ ID NO: 362 - protein, 5 aa, Artificial Sequence
  Synthetic peptide
NYGMH

SEQ ID NO: 363 - protein, 17 aa, Artificial Sequence
  Synthetic peptide
LIWYDASKKYYAESVKG

SEQ ID NO: 364 - protein, 16 aa, Artificial Sequence
  Synthetic peptide
DPSSLTGSTGYYGMDV

SEQ ID NO: 365 - protein, 11 aa, Artificial Sequence
  Synthetic peptide
SGDKLGDKYAS

SEQ ID NO: 366 - protein, 7 aa, Artificial Sequence
  Synthetic peptide
QDRKRPS

SEQ ID NO: 367 - protein, 9 aa, Artificial Sequence
  Synthetic peptide
QAFESSTEV

SEQ ID NO: 368 - protein, 125 aa, Artificial Sequence
  Synthetic peptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSS

SEQ ID NO: 369 - protein, 106 aa, Artificial Sequence
  Synthetic peptide
SYELTQPPSVSVSPGQTASITCSGDKLGDKYASWYQQKPGQSPVLVIYQDRKRPSGIPERFSGSNSGNTATLTISGTQAMDEADYYCQAFESSTEVFGGGTKLTVL

SEQ ID NO: 370 - protein, 477 aa, Artificial Sequence
  Synthetic peptide
MDMRVPAQLLGLLLLWLRGARCQVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 371 - protein, 231 aa, Artificial Sequence
  Synthetic peptide
MAWALLLLTLLTQGTGSWASYELTQPPSVSVSPGQTASITCSGDKLGDKYASWYQQKPGQSPVLVIYQDRKRPSGIPERFSGSNSGNTATLTISGTQAMDEADYYCQAFESSTEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 372 - protein, 5 aa, Artificial Sequence
  Synthetic peptide
DYSMS

SEQ ID NO: 373 - protein, 17 aa, Artificial Sequence
  Synthetic peptide
GINWNGGRTRYADAVKG

SEQ ID NO: 374 - protein, 12 aa, Artificial Sequence
  Synthetic peptide
EFNNFESNWFDP

SEQ ID NO: 375 - protein, 11 aa, Artificial Sequence
  Synthetic peptide
SGDALPKKYAY

SEQ ID NO: 376 - protein, 7 aa, Artificial Sequence
  Synthetic peptide
EDAKRPS

SEQ ID NO: 377 - protein, 11 aa, Artificial Sequence
  Synthetic peptide
YSTDASGNHRV

SEQ ID NO: 378 - protein, 121 aa, Artificial Sequence
  Synthetic peptide
EVQLVESGGSVVRPGGSLRLSCAASGFTVDDYSMSWVRQVPGKGLEWVSGINWNGGRTRYADAVKGRFTISRDSAKNSLYLQMNSLRAEDTALYYCAREFNNFESNWFDPWGQGTLVTVSS

SEQ ID NO: 379 - protein, 108 aa, Artificial Sequence
  Synthetic peptide
SYELTQPPSVSVSPGQTARITCSGDALPKKYAYWYQQKPGQAPVLVISEDAKRPSGIPERFSGSSSGTMATLTISGAQVEDEADYYCYSTDASGNHRVFGGGTKLTVL

SEQ ID NO: 380 - protein, 473 aa, Artificial Sequence
  Synthetic peptide
MDMRVPAQLLGLLLLWLRGARCEVQLVESGGSVVRPGGSLRLSCAASGFTVDDYSMSWVRQVPGKGLEWVSGINWNGGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 381 - protein, 233 aa, Artificial Sequence
  Synthetic peptide
MAWALLLLTLLTQGTGSWASYELTQPPSVSVSPGQTARITCSGDALPKKYAYWYQQKPGQAPVLVISEDAKRPSGIPERFSGSSSGTMATLTISGAQVEDEADYYCYSTDASGNHRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 382 - protein, 5 aa, Artificial Sequence
  Synthetic peptide
DYSMS

SEQ ID NO: 383 - protein, 17 aa, Artificial Sequence
  Synthetic peptide
GINWNAGRTRYADAVKG

SEQ ID NO: 384 - protein, 12 aa, Artificial Sequence
  Synthetic peptide
EFNNFESNWFDP

SEQ ID NO: 385 - protein, 11 aa, Artificial Sequence
  Synthetic peptide
SGDALPKKYAY

SEQ ID NO: 386 - protein, 7 aa, Artificial Sequence
  Synthetic peptide
EDAKRPS

SEQ ID NO: 387 - protein, 11 aa, Artificial Sequence
  Synthetic peptide
YSTDASGNHRV

SEQ ID NO: 388 - protein, 121 aa, Artificial Sequence
  Synthetic peptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSS

SEQ ID NO: 389 - protein, 108 aa, Artificial Sequence; identical to SEQ ID NO: 379
  Synthetic peptide

SEQ ID NO: 390 - protein, 473 aa, Artificial Sequence
  Synthetic peptide
MDMRVPAQLLGLLLLWLRGARCEVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 391 - protein, 233 aa, Artificial Sequence; identical to SEQ ID NO: 381
  Synthetic peptide

SEQ ID NO: 392 - DNA, 15 bp, Artificial Sequence
  Synthetic polynucleotide
aactatggcatgcat

SEQ ID NO: 393 - DNA, 51 bp, Artificial Sequence
  Synthetic polynucleotide
cttatctggtatgatggaagtaaaaaatactatgcagactccgtgaagggc

SEQ ID NO: 394 - DNA, 48 bp, Artificial Sequence
  Synthetic polynucleotide
gatccctcgagtctaactggaagtacgggttactacggtatggacgtc

SEQ ID NO: 395 - DNA, 33 bp, Artificial Sequence
  Synthetic polynucleotide
tctggagataaattgggggataaatatgcttgc

SEQ ID NO: 396 - DNA, 21 bp, Artificial Sequence
  Synthetic polynucleotide
caagatagaaagcggccctca

SEQ ID NO: 397 - DNA, 27 bp, Artificial Sequence
  Synthetic polynucleotide
caggcgtgggacagtagcactgaggta

SEQ ID NO: 398 - DNA, 375 bp, Artificial Sequence
  Synthetic polynucleotide
caggtgcagctggtggagtctgggggaggcgtggtccagcctgggaggtccctgagactctcctgtgcagcgtccggcttcaccttcagtaactatggcatgcattgggtccgccaggctccaggcaaggggctggagtgggtggcacttatctggtatgatggaagtaaaaaatactatgcagactccgtgaagggccgattcaccatctccagagacaattccaagaacacgctgtatctgcaaatgaacagcctgagagccgaggacacggctgcgtattactgtgcgagagatccctcgagtctaactggaagtacgggttactacggtatggacgtctggggccaagggaccacggtcaccgtctcctca

SEQ ID NO: 399 - DNA, 318 bp, Artificial Sequence
  Synthetic polynucleotide
tcctatgagctgactcagccaccctcagtgtccgtgtccccaggacagacagccagcatcacctgctctggagataaattgggggataaatatgcttgctggtatcagcagaagccaggccagtcccctgtgctggtcatttatcaagatagaaagcggccctcagggatccctgagcgattctctggctccaactctgggaacacagccactctgaccatcagcgggacccaggctatggatgaggctgactattactgtcaggcgtgggacagtagcactgaggtattcggcggagggaccaagctgaccgtccta

SEQ ID NO: 400 - DNA, 1431 bp, Artificial Sequence
  Synthetic polynucleotide
atggacatgagggtgcccgctcagctcctggggctcctgctgctgtggctgagaggtgcgcgctgtcaggtgcagctggtggagtctgggggaggcgtggtccagcctgggaggtccctgagactctcctgtgcagcgtccggcttcaccttcagtaactatggcatgcattgggtccgccaggctccaggcaaggggctggagtgggtggcacttatctggtatgatggaagtaaaaaatactatgcagactccgtgaagggccgattcaccatctccagagacaattccaagaacacgctgtatctgcaaatgaacagcctgagagccgaggacacggctgcgtattactgtgcgagagatccctcgagtctaactggaagtacgggttactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 401 - DNA, 693 bp, Artificial Sequence
  Synthetic polynucleotide
atggcctgggctctgctgctcctcaccctcctcactcagggcacagggtcctgggcctcctatgagctgactcagccaccctcagtgtccgtgtccccaggacagacagccagcatcacctgctctggagataaattgggggataaatatgcttgctggtatcagcagaagccaggccagtcccctgtgctggtcatttatcaagatagaaagcggccctcagggatccctgagcgattctctggctccaactctgggaacacagccactctgaccatcagcgggacccaggctatggatgaggctgactattactgtcaggcgtgggacagtagcactgaggtattcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 402 - DNA, 15 bp, Artificial Sequence
  Synthetic polynucleotide
agctatgacatgagc

SEQ ID NO: 403 - DNA, 51 bp, Artificial Sequence
  Synthetic polynucleotide
cttattagtggtggtggtagtaacacatactacgcagactccgtgaagggc

SEQ ID NO: 404 - DNA, 33 bp, Artificial Sequence
  Synthetic polynucleotide
cccagtggccactacttctacgctatggacgtc

SEQ ID NO: 405 - DNA, 33 bp, Artificial Sequence
  Synthetic polynucleotide
cgggcgagtcagggtattagcaactggttagcc

SEQ ID NO: 406 - DNA, 21 bp, Artificial Sequence
  Synthetic polynucleotide
gctgcatccagtttgcaaagt

SEQ ID NO: 407 - DNA, 27 bp, Artificial Sequence
  Synthetic polynucleotide
caacaggctgacagtttccctcacact

SEQ ID NO: 408 - DNA, 360 bp, Artificial Sequence
  Synthetic polynucleotide
gaggtgcagctgttggagtctgggggaggcttggtacagcctgggggggccctgagactctcctgtgcagcctctggattcacctttagcagctatgacatgagctgggtccgccaggctccagggaaggggctggaatgggtctcacttattagtggtggtggtagtaacacatactacgcagactccgtgaagggccggttcaccatctccagagacaattccaagaacacgctgtatctgcaaatgaacagcctgagagccgaggacacggccgtatatttctgtgcgtcccccagtggccactacttctacgctatggacgtctggggccaagggaccacggtcaccgtctcctca

SEQ ID NO: 409 - DNA, 321 bp, Artificial Sequence
  Synthetic polynucleotide
gacatccagatgacccagtctccatcttccgtgtctgcatctgttggagacagagtcaccatcacttgtcgggcgagtcagggtattagcaactggttagcctggtatcagcagaaaccagggaaagcccctaagctcctgatctttgctgcatccagtttgcaaagtggggtcccatcaaggttcggcggcagtggatctgggacagatttcaccttcaccatcagcagcctgcagcctgaagattttgcaacttactattgtcaacaggctgacagtttccctcacactttcggcggagggaccaaggtggagatcaaa

SEQ ID NO: 410 - DNA, 1416 bp, Artificial Sequence
  Synthetic polynucleotide
atggacatgagggtgcccgctcagctcctggggctcctgctgctgtggctgagaggtgcgcgctgtgaggtgcagctgttggagtctgggggaggcttggtacagcctgggggggccctgagactctcctgtgcagcctctggattcacctttagcagctatgacatgagctgggtccgccaggctccagggaaggggctggaatgggtctcacttattagtggtggtggtagtaacacatactacgcagactccgtgaagggccggttcaccatctccagagacaattccaagaacacgctgtatctgcaaatgaacagcctgagagccgaggacacggccgtatatttctgtgcgtcccccagtggccactacttctacgctatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 411 - DNA, 708 bp, Artificial Sequence
  Synthetic polynucleotide
atggacatgagggtgcccgctcagctcctggggctcctgctgctgtggctgagaggtgcgcgctgtgacatccagatgacccagtctccatcttccgtgtctgcatctgttggagacagagtcaccatcacttgtcgggcgagtcagggtattagcaactggttagcctggtatcagcagaaaccagggaaagcccctaagctcctgatctttgctgcatccagtttgcaaagtggggtcccatcaaggttcggcggcagtggatctgggacagatttcaccttcaccatcagcagcctgcagcctgaagattttgcaacttactattgtcaacaggctgacagtttccctcacactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 412 - DNA, 15 bp, Artificial Sequence
  Synthetic polynucleotide
gattatagcatgagc

SEQ ID NO: 413 - DNA, 51 bp, Artificial Sequence
  Synthetic polynucleotide
ggcattaattggaatggtggtaggacacgttatgcagactctgtgaagggc

SEQ ID NO: 414 - DNA, 36 bp, Artificial Sequence
  Synthetic polynucleotide
gaattcaataacttcgagtccaactggttcgacccc

SEQ ID NO: 415 - DNA, 33 bp, Artificial Sequence
  Synthetic polynucleotide
tctggagatgcattgccaaaaaaatatgcttat

SEQ ID NO: 416 - DNA, 21 bp, Artificial Sequence
  Synthetic polynucleotide
gaggacagcaaacgaccctcc

SEQ ID NO: 417 - DNA, 33 bp, Artificial Sequence
  Synthetic polynucleotide
tactcaacagacagcagtggtaatcatagggtg

SEQ ID NO: 418 - DNA, 363 bp, Artificial Sequence
  Synthetic polynucleotide
gaggtgcagctggtggagtctgggggaagtgtggtacggccgggggggtccctgagactctcctgtgcagcctctggattcaccgttgatgattatagcatgagctgggtccgccaagttccagggaaggggctggagtgggtctctggcattaattggaatggtggtaggacacgttatgcagactctgtgaagggccgattcaccatctccagagacagcgccaaaaactccctgtatctgcaaatgaacagtctgagagccgaggatacggccttatattactgtgcgagagaattcaataacttcgagtccaactggttcgacccctggggccagggaaccctggtcaccgtctcctca

SEQ ID NO: 419 - DNA, 324 bp, Artificial Sequence
  Synthetic polynucleotide
tcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctctgaggacagcaaacgaccctccgggatccctgagagattctctggctccagctcagggacaatggccaccttgactatcagtggggcccaggtggaggatgaagctgactactactgttactcaacagacagcagtggtaatcatagggtgttcggcggagggaccaagctgaccgtccta

SEQ ID NO: 420 - DNA, 1419 bp, Artificial Sequence
  Synthetic polynucleotide
atggacatgagggtgcccgctcagctcctggggctcctgctgctgtggctgagaggtgcgcgctgtgaggtgcagctggtggagtctgggggaagtgtggtacggccgggggggtccctgagactctcctgtgcagcctctggattcaccgttgatgattatagcatgagctgggtccgccaagttccagggaaggggctggagtgggtctctggcattaattggaatggtggtaggacacgttatgcagactctgtgaagggccgattcaccatctccagagacagcgccaaaaactccctgtatctgcaaatgaacagtctgagagccgaggatacggccttatattactgtgcgagagaattcaataacttcgagtccaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 421 - DNA, 699 bp, Artificial Sequence
  Synthetic polynucleotide
atggcctgggctctgctgctcctcaccctcctcactcagggcacagggtcctgggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctctgaggacagcaaacgaccctccgggatccctgagagattctctggctccagctcagggacaatggccaccttgactatcagtggggcccaggtggaggatgaagctgactactactgttactcaacagacagcagtggtaatcatagggtgttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 422 - DNA, 15 bp, Artificial Sequence
  Synthetic polynucleotide
agctatgacatgagc

SEQ ID NO: 423 - DNA, 51 bp, Artificial Sequence
  Synthetic polynucleotide
cttattagtggtggtggtagtaacacatactacgcagaatccgtgaagggc

SEQ ID NO: 424 - DNA, 33 bp, Artificial Sequence; identical to SEQ ID NO: 404
  Synthetic polynucleotide

SEQ ID NO: 425 - DNA, 33 bp, Artificial Sequence; identical to SEQ ID NO: 405
  Synthetic polynucleotide

SEQ ID NO: 426 - DNA, 21 bp, Artificial Sequence
  Synthetic polynucleotide
gctgcatccagtttgcaaagt

SEQ ID NO: 427 - DNA, 27 bp, Artificial Sequence
  Synthetic polynucleotide
caacaggctgaaagtttccctcacact

SEQ ID NO: 428 - DNA, 360 bp, Artificial Sequence
  Synthetic polynucleotide
gaggtgcagctgttggagtctgggggaggcttggtacagcctggggggtccctgagactctcctgtgcagcctctggattcacctttagcagctatgacatgagctgggtccgccaggctccagggaaggggctggaatgggtctcacttattagtggtggtggtagtaacacatactacgcagaatccgtgaagggccggttcaccatctccagagacaattccaagaacacgctgtatctgcaaatgaacagcctgagagccgaggacacggccgtatatttctgtgcgtcccccagtggccactacttctacgctatggacgtctggggccaagggaccacggtcaccgtctcctca

SEQ ID NO: 429 - DNA, 321 bp, Artificial Sequence
  Synthetic polynucleotide
gacatccagatgacccagtctccatcttccgtgtctgcatctgttggagacagagtcaccatcacttgtcgggcgagtcagggtattagcaactggttagcctggtatcagcagaaaccagggaaagcccctaagctcctgatctttgctgcatccagtttgcaaagtggggtcccatcaaggttcagcggcagtggatctgggacagatttcaccctcaccatcagcagcctgcagcctgaagattttgcaacttactattgtcaacaggctgaaagtttccctcacactttcggcggagggaccaaggtggagatcaaa

SEQ ID NO: 430 - DNA, 1416 bp, Artificial Sequence
  Synthetic polynucleotide
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgacatgagctgggtccgccaggctccagggaaggggctggaatgggtctcacttattagtggtggtggtagtaacacatactacgcagaatccgtgaagggccggttcaccatctccagagacaattccaagaacacgctgtatctgcaaatgaacagcctgagagccgaggacacggccgtatatttctgtgcgtcccccagtggccactacttctacgctatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 431 - DNA, 708 bp, Artificial Sequence
  Synthetic polynucleotide
atggacatgagggtgcccgctcagctcctggggctcctgctgctgtggctgagaggtgcgcgctgtgacatccagatgacccagtctccatcttccgtgtctgcatctgttggagacagagtcaccatcacttgtcgggcgagtcagggtattagcaactggttagcctggtatcagcagaaaccagggaaagcccctaagctcctgatctttgctgcatccagtttgcaaagtggggtcccatcaaggttcagcggcagtggatctgggacagatttcaccctcaccatcagcagcctgcagcctgaagattttgcaacttactattgtcaacaggctgaaagtttccctcacactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 432 - DNA, 15 bp, Artificial Sequence
  Synthetic polynucleotide
agctatgacatgagc

SEQ ID NO: 433 - DNA, 51 bp, Artificial Sequence
  Synthetic polynucleotide
cttattagtggtggtggtagtcaaacatactacgcagaatccgtgaagggc

SEQ ID NO: 434 - DNA, 33 bp, Artificial Sequence; identical to SEQ ID NO: 404
  Synthetic polynucleotide

SEQ ID NO: 435 - DNA, 33 bp, Artificial Sequence; identical to SEQ ID NO: 405
  Synthetic polynucleotide

SEQ ID NO: 436 - DNA, 21 bp, Artificial Sequence
  Synthetic polynucleotide
gctgcatccagtttgcaaagt

SEQ ID NO: 437 - DNA, 27 bp, Artificial Sequence
  Synthetic polynucleotide
caacaggctgaaagtttccctcacact

SEQ ID NO: 438 - DNA, 360 bp, Artificial Sequence
  Synthetic polynucleotide
gaggtgcagctgttggagtctgggggaggcttggtacagcctggggggtccctgagactctcctgtgcagcctctggattcacctttagcagctatgacatgagctgggtccgccaggctccagggaaggggctggaatgggtctcacttattagtggtggtggtagtcaaacatactacgcagaatccgtgaagggccggttcaccatctccagagacaattccaagaacacgctgtatctgcaaatgaacagcctgagagccgaggacacggccgtatatttctgtgcgtcccccagtggccactacttctacgctatggacgtctggggccaagggaccacggtcaccgtctcctca

SEQ ID NO: 439 - DNA, 321 bp, Artificial Sequence; identical to SEQ ID NO: 429
  Synthetic polynucleotide

SEQ ID NO: 440 - DNA, 1416 bp, Artificial Sequence
  Synthetic polynucleotide
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgacatgagctgggtccgccaggctccagggaaggggctggaatgggtctcacttattagtggtggtggtagtcaaacatactacgcagaatccgtgaagggccggttcaccatctccagagacaattccaagaacacgctgtatctgcaaatgaacagcctgagagccgaggacacggccgtatatttctgtgcgtcccccagtggccactacttctacgctatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 441 - DNA, 708 bp, Artificial Sequence; identical to SEQ ID NO: 431
  Synthetic polynucleotide

SEQ ID NO: 442 - DNA, 15 bp, Artificial Sequence
  Synthetic polynucleotide
aactatggcatgcat

SEQ ID NO: 443 - DNA, 51 bp, Artificial Sequence
  Synthetic polynucleotide
cttatctggtatgatgcaagtaaaaaatactatgcagaatccgtgaagggc

SEQ ID NO: 444 - DNA, 48 bp, Artificial Sequence; identical to SEQ ID NO: 394
  Synthetic polynucleotide

SEQ ID NO: 445 - DNA, 33 bp, Artificial Sequence
  Synthetic polynucleotide
tctggagataaattgggggataaatatgcttcc

SEQ ID NO: 446 - DNA, 21 bp, Artificial Sequence
  Synthetic polynucleotide
caagatagaaagcggccctca

SEQ ID NO: 447 - DNA, 27 bp, Artificial Sequence
  Synthetic polynucleotide
caggcgttcgaaagtagcactgaggta

SEQ ID NO: 448 - DNA, 375 bp, Artificial Sequence
  Synthetic polynucleotide
caggtgcagctggtggagtctgggggaggcgtggtccagcctgggaggtccctgagactctcctgtgcagcgtccggcttcaccttcagtaactatggcatgcattgggtccgccaggctccaggcaaggggctggagtgggtggcacttatctggtatgatgcaagtaaaaaatactatgcagaatccgtgaagggccgattcaccatctccagagacaattccaagaacacgctgtatctgcaaatgaacagcctgagagccgaggacacggctgcgtattactgtgcgagagatccctcgagtctaactggaagtacgggttactacggtatggacgtctggggccaagggaccacggtcaccgtctcctca

SEQ ID NO: 449 - DNA, 318 bp, Artificial Sequence
  Synthetic polynucleotide
tcctatgagctgactcagccaccctcagtgtccgtgtccccaggacagacagccagcatcacctgctctggagataaattgggggataaatatgcttcctggtatcagcagaagccaggccagtcccctgtgctggtcatttatcaagatagaaagcggccctcagggatccctgagcgattctctggctccaactctgggaacacagccactctgaccatcagcgggacccaggctatggatgaggctgactattactgtcaggcgttcgaaagtagcactgaggtattcggcggagggaccaagctgaccgtccta

SEQ ID NO: 450 - DNA, 1431 bp, Artificial Sequence
  Synthetic polynucleotide
atggacatgagggtgcccgctcagctcctggggctcctgctgctgtggctgagaggtgcgcgctgtcaggtgcagctggtggagtctgggggaggcgtggtccagcctgggaggtccctgagactctcctgtgcagcgtccggcttcaccttcagtaactatggcatgcattgggtccgccaggctccaggcaaggggctggagtgggtggcacttatctggtatgatgcaagtaaaaaatactatgcagaatccgtgaagggccgattcaccatctccagagacaattccaagaacacgctgtatctgcaaatgaacagcctgagagccgaggacacggctgcgtattactgtgcgagagatccctcgagtctaactggaagtacgggttactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 451 - DNA, 693 bp, Artificial Sequence
  Synthetic polynucleotide
atggcctgggctctgctgctcctcaccctcctcactcagggcacagggtcctgggcctcctatgagctgactcagccaccctcagtgtccgtgtccccaggacagacagccagcatcacctgctctggagataaattgggggataaatatgcttcctggtatcagcagaagccaggccagtcccctgtgctggtcatttatcaagatagaaagcggccctcagggatccctgagcgattctctggctccaactctgggaacacagccactctgaccatcagcgggacccaggctatggatgaggctgactattactgtcaggcgttcgaaagtagcactgaggtattcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 452 - DNA, 15 bp, Artificial Sequence
  Synthetic polynucleotide
gattatagcatgagc

SEQ ID NO: 453 - DNA, 51 bp, Artificial Sequence
  Synthetic polynucleotide
ggcattaattggaatggtggtaggacacgttatgcagacgctgtgaagggc

SEQ ID NO: 454 - DNA, 36 bp, Artificial Sequence; identical to SEQ ID NO: 414
  Synthetic polynucleotide

SEQ ID NO: 455 - DNA, 33 bp, Artificial Sequence; identical to SEQ ID NO: 415
  Synthetic polynucleotide

SEQ ID NO: 456 - DNA, 21 bp, Artificial Sequence
  Synthetic polynucleotide
gaggacgccaaacgaccctcc

SEQ ID NO: 457 - DNA, 33 bp, Artificial Sequence
  Synthetic polynucleotide
tactcaacagacgccagtggtaatcatagggtg

SEQ ID NO: 458 - DNA, 363 bp, Artificial Sequence
  Synthetic polynucleotide
gaggtgcagctggtggagtctgggggaagtgtggtacggccgggggggtccctgagactctcctgtgcagcctctggattcaccgttgatgattatagcatgagctgggtccgccaagttccagggaaggggctggagtgggtctctggcattaattggaatggtggtaggacacgttatgcagacgctgtgaagggccgattcaccatctccagagacagcgccaaaaactccctgtatctgcaaatgaacagtctgagagccgaggatacggccttatattactgtgcgagagaattcaataacttcgagtccaactggttcgacccctggggccagggaaccctggtcaccgtctcctca

SEQ ID NO: 459 - DNA, 324 bp, Artificial Sequence
  Synthetic polynucleotide
tcctatgagctgacacagccaccctcggtgtcagtgtccccaggacaaacggccaggatcacctgctctggagatgcattgccaaaaaaatatgcttattggtaccagcagaagccaggccaggcccctgtgctggtcatctctgaggacgccaaacgaccctccgggatccctgagagattctctggctccagctcagggacaatggccaccttgactatcagtggggcccaggtggaggatgaagctgactactactgttactcaacagacgccagtggtaatcatagggtgttcggcggagggaccaagctgaccgtccta

SEQ ID NO: 460 - DNA, 1419 bp, Artificial Sequence
  Synthetic polynucleotide
atggacatgagggtgcccgctcagctcctggggctcctgctgctgtggctgagaggtgcgcgctgtgaggtgcagctggtggagtctgggggaagtgtggtacggccgggggggtccctgagactctcctgtgcagcctctggattcaccgttgatgattatagcatgagctgggtccgccaagttccagggaaggggctggagtgggtctctggcattaattggaatggtggtaggacacgttatgcagacgctgtgaagggccgattcaccatctccagagacagcgccaaaaactccctgtatctgcaaatgaacagtctgagagccgaggatacggccttatattactgtgcgagagaattcaataacttcgagtccaactggttcgacccctggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 461 - DNA, 699 bp, Artificial Sequence
  Synthetic polynucleotide
atggcctgggctctgctgctcctcaccctcctcactcagggcacagggtcctgggcctcctatgagctgacacagccaccctcggtgtcagtgtccccaggacaaacggccaggatcacctgctctggagatgcattgccaaaaaaatatgcttattggtaccagcagaagccaggccaggcccctgtgctggtcatctctgaggacgccaaacgaccctccgggatccctgagagattctctggctccagctcagggacaatggccaccttgactatcagtggggcccaggtggaggatgaagctgactactactgttactcaacagacgccagtggtaatcatagggtgttcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 462 - DNA, 15 bp, Artificial Sequence
  Synthetic polynucleotide
gattatagcatgagc

SEQ ID NO: 463 - DNA, 51 bp, Artificial Sequence
  Synthetic polynucleotide
ggcattaattggaatgctggtaggacacgttatgcagacgctgtgaagggc

SEQ ID NO: 464 - DNA, 36 bp, Artificial Sequence; identical to SEQ ID NO: 414
  Synthetic polynucleotide

SEQ ID NO: 465 - DNA, 33 bp, Artificial Sequence; identical to SEQ ID NO: 415
  Synthetic polynucleotide

SEQ ID NO: 466 - DNA, 21 bp, Artificial Sequence
  Synthetic polynucleotide
gaggacgccaaacgaccctcc

SEQ ID NO: 467 - DNA, 33 bp, Artificial Sequence; identical to SEQ ID NO: 457
  Synthetic polynucleotide

SEQ ID NO: 468 - DNA, 363 bp, Artificial Sequence
  Synthetic polynucleotide
gaggtgcagctggtggagtctgggggaagtgtggtacggccgggggggtccctgagactctcctgtgcagcctctggattcaccgttgatgattatagcatgagctgggtccgccaagttccagggaaggggctggagtgggtctctggcattaattggaatgctggtaggacacgttatgcagacgctgtgaagggccgattcaccatctccagagacagcgccaaaaactccctgtatctgcaaatgaacagtctgagagccgaggatacggccttatattactgtgcgagagaattcaataacttcgagtccaactggttcgacccctggggccagggaaccctggtcaccgtgtcctca

SEQ ID NO: 469 - DNA, 324 bp, Artificial Sequence; identical to SEQ ID NO: 459
  Synthetic polynucleotide

SEQ ID NO: 470 - DNA, 1419 bp, Artificial Sequence
  Synthetic polynucleotide
atggacatgagggtgcccgctcagctcctggggctcctgctgctgtggctgagaggtgcgcgctgtgaggtgcagctggtggagtctgggggaagtgtggtacggccgggggggtccctgagactctcctgtgcagcctctggattcaccgttgatgattatagcatgagctgggtccgccaagttccagggaaggggctggagtgggtctctggcattaattggaatgctggtaggacacgttatgcagacgctgtgaagggccgattcaccatctccagagacagcgccaaaaactccctgtatctgcaaatgaacagtctgagagccgaggatacggccttatattactgtgcgagagaattcaataacttcgagtccaactggttcgacccctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaa

SEQ ID NO: 471 - DNA, 699 bp, Artificial Sequence; identical to SEQ ID NO: 461
  Synthetic polynucleotide

SEQ ID NO: 472 - protein, 330 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGK

SEQ ID NO: 473 - protein, 330 aa, Artificial Sequence; identical to SEQ ID NO: 295
  Synthetic peptide

SEQ ID NO: 474 - protein, 329 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPG

SEQ ID NO: 475 - protein, 329 aa, Artificial Sequence; identical to SEQ ID NO: 297
  Synthetic peptide

SEQ ID NO: 476 - protein, 334 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGGGGGS

SEQ ID NO: 477 - protein, 334 aa, Artificial Sequence; identical to SEQ ID NO: 299
  Synthetic peptide

SEQ ID NO: 478 - protein, 330 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTENQVSLTCLVEGFYPSDIAVEWESNGQPENNYETTPPVLDSDGSFFLYSDLTVDKSRWQQGNVFSCSVMHEALHNHYTQKSLSLSPGK

SEQ ID NO: 479 - protein, 330 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 480 - protein, 329 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTENQVSLTCLVEGFYPSDIAVEWESNGQPENNYETTPPVLDSDGSFFLYSDLTVDKSRWQQGNVFSCSVMHEALHNHYTQKSLSLSPG

SEQ ID NO: 481 - protein, 329 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 482 - protein, 334 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTENQVSLTCLVEGFYPSDIAVEWESNGQPENNYETTPPVLDSDGSFFLYSDLTVDKSRWQQGNVFSCSVMHEALHNHYTQKSLSLSPGGGGGS

SEQ ID NO: 483 - protein, 334 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGS

SEQ ID NO: 484 - protein, 330 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGK

SEQ ID NO: 485 - protein, 330 aa, Artificial Sequence; identical to SEQ ID NO: 307
  Synthetic peptide

SEQ ID NO: 486 - protein, 329 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPG

SEQ ID NO: 487 - protein, 329 aa, Artificial Sequence; identical to SEQ ID NO: 309
  Synthetic peptide

SEQ ID NO: 488 - protein, 334 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGGGGGS

SEQ ID NO: 489 - protein, 334 aa, Artificial Sequence; identical to SEQ ID NO: 311
  Synthetic peptide

SEQ ID NO: 490 - protein, 330 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTENQVSLTCLVEGFYPSDIAVEWESNGQPENNYETTPPVLDSDGSFFLYSDLTVDKSRWQQGNVFSCSVMHEALHNHYTQKSLSLSPGK

SEQ ID NO: 491 - protein, 330 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 492 - protein, 329 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTENQVSLTCLVEGFYPSDIAVEWESNGQPENNYETTPPVLDSDGSFFLYSDLTVDKSRWQQGNVFSCSVMHEALHNHYTQKSLSLSPG

SEQ ID NO: 493 - protein, 329 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 494 - protein, 334 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTENQVSLTCLVEGFYPSDIAVEWESNGQPENNYETTPPVLDSDGSFFLYSDLTVDKSRWQQGNVFSCSVMHEALHNHYTQKSLSLSPGGGGGS

SEQ ID NO: 495 - protein, 334 aa, Artificial Sequence
  Synthetic peptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGS

SEQ ID NO: 496 - protein, 584 aa, Artificial Sequence
  Synthetic peptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 497 - protein, 584 aa, Artificial Sequence
  Synthetic peptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 498 - protein, 583 aa, Artificial Sequence
  Synthetic peptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 499 - protein, 588 aa, Artificial Sequence
  Synthetic peptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 500 - protein, 588 aa, Artificial Sequence
  Synthetic peptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 501 - protein, 583 aa, Artificial Sequence
  Synthetic peptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 502 - protein, 583 aa, Artificial Sequence; identical to SEQ ID NO: 501
  Synthetic peptide

SEQ ID NO: 503 - protein, 583 aa, Artificial Sequence
  Synthetic peptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 504 - protein, 583 aa, Artificial Sequence
  Synthetic peptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 505 - protein, 583 aa, Artificial Sequence; identical to SEQ ID NO: 504
  Synthetic peptide

SEQ ID NO: 506 - protein, 583 aa, Artificial Sequence
  Synthetic peptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 507 - protein, 588 aa, Artificial Sequence
  Synthetic peptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 508 - protein, 587 aa, Artificial Sequence
  Synthetic peptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 509 - protein, 588 aa, Artificial Sequence
  Synthetic peptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 510 - protein, 587 aa, Artificial Sequence
  Synthetic peptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 511 - protein, 592 aa, Artificial Sequence
  Synthetic peptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 512 - protein, 592 aa, Artificial Sequence
  Synthetic peptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 513 - protein, 587 aa, Artificial Sequence
  Synthetic peptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 514 - protein, 587 aa, Artificial Sequence; identical to SEQ ID NO: 513
  Synthetic peptide

SEQ ID NO: 515 - protein, 587 aa, Artificial Sequence
  Synthetic peptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 516 - protein, 587 aa, Artificial Sequence
  Synthetic peptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 517 - protein, 587 aa, Artificial Sequence; identical to SEQ ID NO: 516
  Synthetic peptide

SEQ ID NO: 518 - protein, 587 aa, Artificial Sequence
  Synthetic peptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 519 - protein, 583 aa, Artificial Sequence
  Synthetic peptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 520 - protein, 236 aa, Artificial Sequence; identical to SEQ ID NO: 351
  Synthetic Polypeptide

SEQ ID NO: 521 - protein, 472 aa, Artificial Sequence
  Synthetic Polypeptide
MDMRVPAQLLGLLLLWLRGARCEVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 522 - protein, 236 aa, Artificial Sequence; identical to SEQ ID NO: 351
  Synthetic Polypeptide

SEQ ID NO: 523 - protein, 472 aa, Artificial Sequence
  Synthetic Polypeptide
MDMRVPAQLLGLLLLWLRGARCEVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVDHHDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 524 - protein, 231 aa, Artificial Sequence; identical to SEQ ID NO: 371
  Synthetic Polypeptide

SEQ ID NO: 525 - protein, 477 aa, Artificial Sequence
  Synthetic Polypeptide
MDMRVPAQLLGLLLLWLRGARCQVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 526 - protein, 231 aa, Artificial Sequence; identical to SEQ ID NO: 371
  Synthetic Polypeptide

SEQ ID NO: 527 - protein, 477 aa, Artificial Sequence
  Synthetic Polypeptide
MDMRVPAQLLGLLLLWLRGARCQVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVDHHDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 528 - protein, 232 aa, Artificial Sequence
  Synthetic Polypeptide
MAWALLLLTLLTQGTGSWASYELTQPPSVSVSPGQTARITCSGDALPKKYAYWYQQKPGQAPVLVISEDAKRPSGIPERFSGSSSGTMATLTISGAQVEDEADYYCYSTDASGNHRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEC

SEQ ID NO: 529 - protein, 473 aa, Artificial Sequence
  Synthetic Polypeptide
MDMRVPAQLLGLLLLWLRGARCEVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 530 - protein, 233 aa, Artificial Sequence; identical to SEQ ID NO: 381
  Synthetic Polypeptide

SEQ ID NO: 531 - protein, 473 aa, Artificial Sequence
  Synthetic Polypeptide
MDMRVPAQLLGLLLLWLRGARCEVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVDHHDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 532 - DNA, 708 bp, Artificial Sequence; identical to SEQ ID NO: 431
  Synthetic Polynucleotide

SEQ ID NO: 533 - DNA, 1416 bp, Artificial Sequence
  Synthetic Polynucleotide
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgacatgagctgggtccgccaggctccagggaaggggctggaatgggtgtcacttattagtggtggtggtagtcaaacatactacgcagaatccgtgaagggccggttcaccatctccagagacaattccaagaacacgctgtatctgcaaatgaacagcctgagagccgaggacacggccgtatatttctgtgcgtcccccagtggccactacttctacgctatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctatatcacccgggagcctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaa

SEQ ID NO: 534 - DNA, 708 bp, Artificial Sequence; identical to SEQ ID NO: 431
  Synthetic Polynucleotide

SEQ ID NO: 535 - DNA, 1416 bp, Artificial Sequence
  Synthetic Polynucleotide
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgacatgagctgggtccgccaggctccagggaaggggctggaatgggtgtcacttattagtggtggtggtagtcaaacatactacgcagaatccgtgaagggccggttcaccatctccagagacaattccaagaacacgctgtatctgcaaatgaacagcctgagagccgaggacacggccgtatatttctgtgcgtcccccagtggccactacttctacgctatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtggaccaccacgactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacagccactacacgcagaagagcctctccctgtctccgggcaaa

SEQ ID NO: 536 - DNA, 693 bp, Artificial Sequence; identical to SEQ ID NO: 451
  Synthetic Polynucleotide

SEQ ID NO: 537 - DNA, 693 bp, Artificial Sequence; identical to SEQ ID NO: 451
  Synthetic Polynucleotide

SEQ ID NO: 538 - DNA, 693 bp, Artificial Sequence; identical to SEQ ID NO: 451
  Synthetic Polynucleotide

SEQ ID NO: 539 - DNA, 1431 bp, Artificial Sequence
  Synthetic Polynucleotide
atggacatgagggtgcccgctcagctcctggggctcctgctgctgtggctgagaggtgcgcgctgtcaggtgcagctggtggagtctgggggaggcgtggtccagcctgggaggtccctgagactctcctgtgcagcgtccggcttcaccttcagtaactatggcatgcattgggtccgccaggctccaggcaaggggctggagtgggtggcacttatctggtatgatgcaagtaaaaaatactatgcagaatccgtgaagggccgattcaccatctccagagacaattccaagaacacgctgtatctgcaaatgaacagcctgagagccgaggacacggctgcgtattactgtgcgagagatccctcgagtctaactggaagtacgggttactacggtatggacgtctggggccaagggaccacggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtggaccaccacgactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacagccactacacgcagaagagcctctccctgtctccgggcaaa

SEQ ID NO: 540 - DNA, 699 bp, Artificial Sequence; identical to SEQ ID NO: 461
  Synthetic Polynucleotide

SEQ ID NO: 541 - DNA, 1419 bp, Artificial Sequence
  Synthetic Polynucleotide
atggacatgagggtgcccgctcagctcctggggctcctgctgctgtggctgagaggtgcgcgctgtgaggtgcagctggtggagtctgggggaagtgtggtacggccgggggggtccctgagactctcctgtgcagcctctggattcaccgttgatgattatagcatgagctgggtccgccaagttccagggaaggggctggagtgggtgtctggcattaattggaatgctggtaggacacgttatgcagacgctgtgaagggccgattcaccatctccagagacagcgccaaaaactccctgtatctgcaaatgaacagtctgagagccgaggatacggccttatattactgtgcgagagaattcaataacttcgagtccaactggttcgacccctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctctatatcacccgggagcctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaa

SEQ ID NO: 542 - DNA, 699 bp, Artificial Sequence; identical to SEQ ID NO: 461
  Synthetic Polynucleotide

SEQ ID NO: 543 - DNA, 1419 bp, Artificial Sequence
  Synthetic Polynucleotide
atggacatgagggtgcccgctcagctcctggggctcctgctgctgtggctgagaggtgcgcgctgtgaggtgcagctggtggagtctgggggaagtgtggtacggccgggggggtccctgagactctcctgtgcagcctctggattcaccgttgatgattatagcatgagctgggtccgccaagttccagggaaggggctggagtgggtgtctggcattaattggaatgctggtaggacacgttatgcagacgctgtgaagggccgattcaccatctccagagacagcgccaaaaactccctgtatctgcaaatgaacagtctgagagccgaggatacggccttatattactgtgcgagagaattcaataacttcgagtccaactggttcgacccctggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtggaccaccacgactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacagccactacacgcagaagagcctctccctgtctccgggcaaa

SEQ ID NO: 544 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 545 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 546 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 547 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 548 - protein, 334 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVDHHDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGGGGGS

SEQ ID NO: 549 - protein, 334 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGS

SEQ ID NO: 550 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVDHHDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPGK

SEQ ID NO: 551 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 552 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVDHHDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHSHYTQKSLSLSPG

SEQ ID NO: 553 - protein, 329 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 554 - protein, 334 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLYITREPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGS

SEQ ID NO: 555 - protein, 334 aa, Artificial Sequence; identical to SEQ ID NO: 554
  Synthetic Polypeptide

SEQ ID NO: 556 - protein, 450 aa, Artificial Sequence
  Synthetic Polypeptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 557 - protein, 450 aa, Artificial Sequence
  Synthetic Polypeptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPG

SEQ ID NO: 558 - protein, 450 aa, Artificial Sequence
  Synthetic Polypeptide
EVQLVESGGSVVRPGGSLRLSCAASGFTVDDYSMSWVRQVPGKGLEWVSGINWNAGRTRYADAVKGRFTISRDSAKNSLYLQMNSLRAEDTALYYCAREFNNFESNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTENQVSLTCLVEGFYPSDIAVEWESNGQPENNYETTPPVLDSDGSFFLYSDLTVDKSRWQQGNVFSCSVMHEALHNHYTQKSLSLSPG

SEQ ID NO: 559 - protein, 454 aa, Artificial Sequence
  Synthetic Polypeptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 560 - protein, 454 aa, Artificial Sequence
  Synthetic Polypeptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPG

SEQ ID NO: 561 - protein, 454 aa, Artificial Sequence
  Synthetic Polypeptide
QVQLVESGGGVVQPGRSLRLSCAASGFTFSNYGMHWVRQAPGKGLEWVALIWYDASKKYYAESVKGRFTISRDNSKNTLYLQMNSLRAEDTAAYYCARDPSSLTGSTGYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTENQVSLTCLVEGFYPSDIAVEWESNGQPENNYETTPPVLDSDGSFFLYSDLTVDKSRWQQGNVFSCSVMHEALHNHYTQKSLSLSPG

SEQ ID NO: 562 - protein, 583 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 563 - protein, 582 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 564 - protein, 583 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 565 - protein, 582 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 566 - protein, 587 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 567 - protein, 587 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 568 - protein, 582 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 569 - protein, 582 aa, Artificial Sequence; identical to SEQ ID NO: 568
  Synthetic Polypeptide

SEQ ID NO: 570 - protein, 582 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKAKPPSTNAGRRQKHRLTCPSCDSYEKKPPKEFLERFKSLLQKMIHQHLSSRTHGSEDS

SEQ ID NO: 571 - protein, 582 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 572 - protein, 582 aa, Artificial Sequence; identical to SEQ ID NO: 571
  Synthetic Polypeptide

SEQ ID NO: 573 - protein, 582 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREKMTKNQVSLTCLVKGFYPSDIAVEWESNGQPENNYKTTPPVLKSDGSFFLYSKLTVDKSRWQQGNVFSCSVMHEALHNHYTQKSLSLSPGQGQDRHMIEMRQLIDIVDQLKNYVNDLVPEFLPAPEDVETNCEWSAFSCFQKAQLKSANTGNNERIINVSIKKLKEKPPSTNAGRRQKHRLTCPSCDSYEKKPPKEFLERFKSLLQKMIHQHLSSRTHGSEDS

SEQ ID NO: 574 - protein, 449 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPG

SEQ ID NO: 575 - protein, 449 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPG

SEQ ID NO: 576 - protein, 449 aa, Artificial Sequence
  Synthetic Polypeptide
EVQLLESGGGLVQPGGSLRLSCAASGFTFSSYDMSWVRQAPGKGLEWVSLISGGGSQTYYAESVKGRFTISRDNSKNTLYLQMNSLRAEDTAVYFCASPSGHYFYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTENQVSLTCLVEGFYPSDIAVEWESNGQPENNYETTPPVLDSDGSFFLYSDLTVDKSRWQQGNVFSCSVMHEALHNHYTQKSLSLSPG

SEQ ID NO: 577 - protein, 105 aa, Homo sapiens
  MISC_FEATURE: CD3 epsilon  ECD
QDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMD

SEQ ID NO: 578 - protein, 27 aa, Homo sapiens
  MISC_FEATURE: CD3 epsilon  ECD pos. 1-27
QDGNEEMGGITQTPYKVSISGTTVILT

SEQ ID NO: 579 - protein, 14 aa, Artificial Sequence
  Synthetic Polypeptide
  MISC_FEATURE: CDR-L1 of F6A
GSSTGAVTSGYYPN

SEQ ID NO: 580 - protein, 7 aa, Artificial Sequence
  Synthetic Polypeptide
  MISC_FEATURE: CDR-L2 of F6A
GTKFLAP

SEQ ID NO: 581 - protein, 9 aa, Artificial Sequence
  Synthetic Polypeptide
  MISC_FEATURE: CDR-L3 of F6A
ALWYSNRWV

SEQ ID NO: 582 - protein, 5 aa, Artificial Sequence
  Synthetic Polypeptide
  MISC_FEATURE: CDR-H1 of F6A
IYAMN

SEQ ID NO: 583 - protein, 19 aa, Artificial Sequence
  Synthetic Polypeptide
  MISC_FEATURE: CDR-H2 of F6A
RIRSKYNNYATYYADSVKS

SEQ ID NO: 584 - protein, 14 aa, Artificial Sequence
  Synthetic Polypeptide
  MISC_FEATURE: CDR-H3 of F6A
HGNFGNSYVSFFAY

SEQ ID NO: 585 - protein, 125 aa, Artificial Sequence
  Synthetic Polypeptide
  MISC_FEATURE: VH of F6A
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 586 - protein, 125 aa, Artificial Sequence
  Synthetic Polypeptide
  MISC_FEATURE: VH variant of F6A
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSS

SEQ ID NO: 587 - protein, 109 aa, Artificial Sequence
  Synthetic Polypeptide
  MISC_FEATURE: VL of F6A
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 588 - protein, 249 aa, Artificial Sequence
  Synthetic Polypeptide
  MISC_FEATURE: scFv of F6A
EVQLVESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 589 - protein, 249 aa, Artificial Sequence
  Synthetic Polypeptide
  MISC_FEATURE: scFv variant of F6A
EVQLLESGGGLVQPGGSLKLSCAASGFTFNIYAMNWVRQAPGKGLEWVARIRSKYNNYATYYADSVKSRFTISRDDSKNTAYLQMNNLKTEDTAVYYCVRHGNFGNSYVSFFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 590 - protein, 14 aa, Artificial Sequence
  Synthetic Polypeptide
  MISC_FEATURE: CDR-L1 of H2C
GSSTGAVTSGYYPN

SEQ ID NO: 591 - protein, 7 aa, Artificial Sequence
  Synthetic Polypeptide
  MISC_FEATURE: CDR-L2 of H2C
GTKFLAP

SEQ ID NO: 592 - protein, 9 aa, Artificial Sequence
  Synthetic Polypeptide
  MISC_FEATURE: CDR-L3 of H2C
ALWYSNRWV

SEQ ID NO: 593 - protein, 5 aa, Artificial Sequence
  Synthetic Polypeptide
  MISC_FEATURE: CDR-H1 of H2C
KYAMN

SEQ ID NO: 594 - protein, 19 aa, Artificial Sequence
  Synthetic Polypeptide
  MISC_FEATURE: CDR-H2 of H2C
RIRSKYNNYATYYADSVKD

SEQ ID NO: 595 - protein, 14 aa, Artificial Sequence
  Synthetic Polypeptide
  MISC_FEATURE: CDR-H3 of H2C
HGNFGNSYISYWAY

SEQ ID NO: 596 - protein, 125 aa, Artificial Sequence
  Synthetic Polypeptide
  MISC_FEATURE: VH of H2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 597 - protein, 125 aa, Artificial Sequence
  Synthetic Polypeptide
  MISC_FEATURE: VH variant of H2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 598 - protein, 109 aa, Artificial Sequence; identical to SEQ ID NO: 587
  Synthetic Polypeptide
  MISC_FEATURE: VL of H2C

SEQ ID NO: 599 - protein, 109 aa, Artificial Sequence
  Synthetic Polypeptide
  MISC_FEATURE: VL variant of H2C
ELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 600 - protein, 249 aa, Artificial Sequence
  Synthetic Polypeptide
  MISC_FEATURE: scFv of H2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 601 - protein, 249 aa, Artificial Sequence
  Synthetic Polypeptide
  MISC_FEATURE: scFv variant of H2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 602 - protein, 14 aa, Artificial Sequence
  Synthetic Polypeptide
  MISC_FEATURE: CDR-L1 of H1E
GSSTGAVTSGYYPN

SEQ ID NO: 603 - protein, 7 aa, Artificial Sequence
  Synthetic Polypeptide
  MISC_FEATURE: CDR-L2 of H1E
GTKFLAP

SEQ ID NO: 604 - protein, 9 aa, Artificial Sequence
  Synthetic Polypeptide
  MISC_FEATURE: CDR-L3 of H1E
ALWYSNRWV

SEQ ID NO: 605 - protein, 5 aa, Artificial Sequence
  Synthetic Polypeptide
  MISC_FEATURE: CDR-H1 of H1E
SYAMN

SEQ ID NO: 606 - protein, 19 aa, Artificial Sequence
  Synthetic Polypeptide
  MISC_FEATURE: CDR-H2 of H1E
RIRSKYNNYATYYADSVKG

SEQ ID NO: 607 - protein, 14 aa, Artificial Sequence
  Synthetic Polypeptide
  MISC_FEATURE: CDR-H3 of H1E
HGNFGNSYLSFWAY

SEQ ID NO: 608 - protein, 125 aa, Artificial Sequence
  Synthetic Polypeptide
  MISC_FEATURE: VH of H1E
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 609 - protein, 125 aa, Artificial Sequence
  Synthetic Polypeptide
  MISC_FEATURE: VH variant of H1E
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSS

SEQ ID NO: 610 - protein, 109 aa, Artificial Sequence; identical to SEQ ID NO: 587
  Synthetic Polypeptide
  MISC_FEATURE: VL of H1E

SEQ ID NO: 611 - protein, 249 aa, Artificial Sequence
  Synthetic Polypeptide
  MISC_FEATURE: scFv of H1E
EVQLVESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 612 - protein, 249 aa, Artificial Sequence
  Synthetic Polypeptide
  MISC_FEATURE: scFv variant of H1E
EVQLLESGGGLEQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYLSFWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 613 - protein, 14 aa, Artificial Sequence
  Synthetic Polypeptide
  MISC_FEATURE: CDR-L1 of G4H
GSSTGAVTSGYYPN

SEQ ID NO: 614 - protein, 7 aa, Artificial Sequence
  Synthetic Polypeptide
  MISC_FEATURE: CDR-L2 of G4H
GTKFLAP

SEQ ID NO: 615 - protein, 9 aa, Artificial Sequence
  Synthetic Polypeptide
  MISC_FEATURE: CDR-L3 of G4H
ALWYSNRWV

SEQ ID NO: 616 - protein, 5 aa, Artificial Sequence
  Synthetic Polypeptide
  MISC_FEATURE: CDR-H1 of G4H
RYAMN

SEQ ID NO: 617 - protein, 19 aa, Artificial Sequence
  Synthetic Polypeptide
  MISC_FEATURE: CDR-H2 of G4H
RIRSKYNNYATYYADSVKG

SEQ ID NO: 618 - protein, 14 aa, Artificial Sequence
  Synthetic Polypeptide
  MISC_FEATURE: CDR-H3 of G4H
HGNFGNSYLSYFAY

SEQ ID NO: 619 - protein, 125 aa, Artificial Sequence
  Synthetic Polypeptide
  MISC_FEATURE: VH of G4H
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 620 - protein, 125 aa, Artificial Sequence
  Synthetic Polypeptide
  MISC_FEATURE: VH variant of G4H
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSS

SEQ ID NO: 621 - protein, 109 aa, Artificial Sequence; identical to SEQ ID NO: 587
  Synthetic Polypeptide
  MISC_FEATURE: VL of G4H

SEQ ID NO: 622 - protein, 249 aa, Artificial Sequence
  Synthetic Polypeptide
  MISC_FEATURE: scFv of G4H
EVQLVESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 623 - protein, 249 aa, Artificial Sequence
  Synthetic Polypeptide
  MISC_FEATURE: scFv variant of G4H
EVQLLESGGGLVQPGGSLKLSCAASGFTFNRYAMNWVRQAPGKGLEWVARIRSKYNNYATYYADSVKGRFTISRDDSKNTAYLQMNNLKTEDTAVYYCVRHGNFGNSYLSYFAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 624 - protein, 14 aa, Artificial Sequence
  Synthetic Polypeptide
  MISC_FEATURE: CDR-L1 of A2J
RSSTGAVTSGYYPN

SEQ ID NO: 625 - protein, 7 aa, Artificial Sequence
  Synthetic Polypeptide
  MISC_FEATURE: CDR-L2 of A2J
ATDMRPS

SEQ ID NO: 626 - protein, 9 aa, Artificial Sequence
  Synthetic Polypeptide
  MISC_FEATURE: CDR-L3 of A2J
ALWYSNRWV

SEQ ID NO: 627 - protein, 5 aa, Artificial Sequence
  Synthetic Polypeptide
  MISC_FEATURE: CDR-H1 of A2J
VYAMN

SEQ ID NO: 628 - protein, 19 aa, Artificial Sequence
  Synthetic Polypeptide
  MISC_FEATURE: CDR-H2 of A2J
RIRSKYNNYATYYADSVKK

SEQ ID NO: 629 - protein, 14 aa, Artificial Sequence
  Synthetic Polypeptide
  MISC_FEATURE: CDR-H3 of A2J
HGNFGNSYLSWWAY

SEQ ID NO: 630 - protein, 125 aa, Artificial Sequence
  Synthetic Polypeptide
  MISC_FEATURE: VH of A2J
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 631 - protein, 125 aa, Artificial Sequence
  Synthetic Polypeptide
  MISC_FEATURE: VH variant of A2J
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSS

SEQ ID NO: 632 - protein, 109 aa, Artificial Sequence
  Synthetic Polypeptide
  MISC_FEATURE: VL of A2J
QTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 633 - protein, 109 aa, Artificial Sequence
  Synthetic Polypeptide
  MISC_FEATURE: VL variant of A2J
ELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 634 - protein, 249 aa, Artificial Sequence
  Synthetic Polypeptide
  MISC_FEATURE: scFv of A2J
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 635 - protein, 249 aa, Artificial Sequence
  Synthetic Polypeptide
  MISC_FEATURE: scFv variant of A2J
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYLSWWAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 636 - protein, 14 aa, Artificial Sequence
  Synthetic Polypeptide
  MISC_FEATURE: CDR-L1 of E1L
GSSTGAVTSGYYPN

SEQ ID NO: 637 - protein, 7 aa, Artificial Sequence
  Synthetic Polypeptide
  MISC_FEATURE: CDR-L2 of E1L
GTKFLAP

SEQ ID NO: 638 - protein, 9 aa, Artificial Sequence
  Synthetic Polypeptide
  MISC_FEATURE: CDR-L3 of E1L
ALWYSNRWV

SEQ ID NO: 639 - protein, 5 aa, Artificial Sequence
  Synthetic Polypeptide
  MISC_FEATURE: CDR-H1 of E1L
KYAMN

SEQ ID NO: 640 - protein, 19 aa, Artificial Sequence
  Synthetic Polypeptide
  MISC_FEATURE: CDR-H2 of E1L
RIRSKYNNYATYYADSVKS

SEQ ID NO: 641 - protein, 14 aa, Artificial Sequence
  Synthetic Polypeptide
  MISC_FEATURE: CDR-H3 of E1L
HGNFGNSYTSYYAY

SEQ ID NO: 642 - protein, 125 aa, Artificial Sequence
  Synthetic Polypeptide
  MISC_FEATURE: VH of E1L
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 643 - protein, 125 aa, Artificial Sequence
  Synthetic Polypeptide
  MISC_FEATURE: VH variant of E1L
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSS

SEQ ID NO: 644 - protein, 109 aa, Artificial Sequence; identical to SEQ ID NO: 587
  Synthetic Polypeptide
  MISC_FEATURE: VL of E1L

SEQ ID NO: 645 - protein, 249 aa, Artificial Sequence
  Synthetic Polypeptide
  MISC_FEATURE: scFv of E1L
EVQLVESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 646 - protein, 249 aa, Artificial Sequence
  Synthetic Polypeptide
  MISC_FEATURE: scFv variant of E1L
EVQLLESGGGLVQPGGSLKLSCAASGFTFNKYAMNWVRQAPGKGLEWVARIRSKYNNYATYYADSVKSRFTISRDDSKNTAYLQMNNLKTEDTAVYYCVRHGNFGNSYTSYYAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 647 - protein, 14 aa, Artificial Sequence
  Synthetic Polypeptide
  MISC_FEATURE: CDR-L1 of E2M
RSSTGAVTSGYYPN

SEQ ID NO: 648 - protein, 7 aa, Artificial Sequence
  Synthetic Polypeptide
  MISC_FEATURE: CDR-L2 of E2M
ATDMRPS

SEQ ID NO: 649 - protein, 9 aa, Artificial Sequence
  Synthetic Polypeptide
  MISC_FEATURE: CDR-L3 of E2M
ALWYSNRWV

SEQ ID NO: 650 - protein, 5 aa, Artificial Sequence
  Synthetic Polypeptide
  MISC_FEATURE: CDR-H1 of E2M
GYAMN

SEQ ID NO: 651 - protein, 19 aa, Artificial Sequence
  Synthetic Polypeptide
  MISC_FEATURE: CDR-H2 of E2M
RIRSKYNNYATYYADSVKE

SEQ ID NO: 652 - protein, 14 aa, Artificial Sequence
  Synthetic Polypeptide
  MISC_FEATURE: CDR-H3 of E2M
HRNFGNSYLSWFAY

SEQ ID NO: 653 - protein, 125 aa, Artificial Sequence
  Synthetic Polypeptide
  MISC_FEATURE: VH of E2M
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 654 - protein, 125 aa, Artificial Sequence
  Synthetic Polypeptide
  MISC_FEATURE: VH variant of E2M
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSS

SEQ ID NO: 655 - protein, 109 aa, Artificial Sequence; identical to SEQ ID NO: 632
  Synthetic Polypeptide
  MISC_FEATURE: VL of E2M

SEQ ID NO: 656 - protein, 249 aa, Artificial Sequence
  Synthetic Polypeptide
  MISC_FEATURE: scFv of E2M
EVQLVESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSQTVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 657 - protein, 249 aa, Artificial Sequence
  Synthetic Polypeptide
  MISC_FEATURE: scFv variant of E2M
EVQLLESGGGLVQPGGSLKLSCAASGFTFNGYAMNWVRQAPGKGLEWVARIRSKYNNYATYYADSVKERFTISRDDSKNTAYLQMNNLKTEDTAVYYCVRHRNFGNSYLSWFAYWGQGTLVTVSSGGGGSGGGGSGGGGSELVVTQEPSLTVSPGGTVTLTCRSSTGAVTSGYYPNWVQQKPGQAPRGLIGATDMRPSGTPARFSGSLLGGKAALTLSGVQPEDEAEYYCALWYSNRWVFGGGTKLTVL

SEQ ID NO: 658 - protein, 14 aa, Artificial Sequence
  Synthetic Polypeptide
  MISC_FEATURE: CDR-L1 of F7O
GSSTGAVTSGYYPN

SEQ ID NO: 659 - protein, 7 aa, Artificial Sequence
  Synthetic Polypeptide
  MISC_FEATURE: CDR-L2 of F7O
GTKFLAP

SEQ ID NO: 660 - protein, 9 aa, Artificial Sequence
  Synthetic Polypeptide
  MISC_FEATURE: CDR-L3 of F7O
ALWYSNRWV

SEQ ID NO: 661 - protein, 5 aa, Artificial Sequence
  Synthetic Polypeptide
  MISC_FEATURE: CDR-H1 of F7O
VYAMN

SEQ ID NO: 662 - protein, 19 aa, Artificial Sequence
  Synthetic Polypeptide
  MISC_FEATURE: CDR-H2 of F7O
RIRSKYNNYATYYADSVKK

SEQ ID NO: 663 - protein, 14 aa, Artificial Sequence
  Synthetic Polypeptide
  MISC_FEATURE: CDR-H3 of F7O
HGNFGNSYISWWAY

SEQ ID NO: 664 - protein, 125 aa, Artificial Sequence
  Synthetic Polypeptide
  MISC_FEATURE: VH of F7O
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 665 - protein, 125 aa, Artificial Sequence
  Synthetic Polypeptide
  MISC_FEATURE: VH variant of F7O
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSS

SEQ ID NO: 666 - protein, 109 aa, Artificial Sequence; identical to SEQ ID NO: 587
  Synthetic Polypeptide
  MISC_FEATURE: VL of F7O

SEQ ID NO: 667 - protein, 249 aa, Artificial Sequence
  Synthetic Polypeptide
  MISC_FEATURE: scFv of F7O
EVQLVESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSQTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 668 - protein, 249 aa, Artificial Sequence
  Synthetic Polypeptide
  MISC_FEATURE: scFv variant of F7O
EVQLLESGGGLVQPGGSLKLSCAASGFTFNVYAMNWVRQAPGKGLEWVARIRSKYNNYATYYADSVKKRFTISRDDSKNTAYLQMNNLKTEDTAVYYCVRHGNFGNSYISWWAYWGQGTLVTVSSGGGGSGGGGSGGGGSELVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 669 - protein, 14 aa, Artificial Sequence
  Synthetic Polypeptide
  MISC_FEATURE: CDR-L1 of F12Q
GSSTGAVTSGNYPN

SEQ ID NO: 670 - protein, 7 aa, Artificial Sequence
  Synthetic Polypeptide
  MISC_FEATURE: CDR-L2 of F12Q
GTKFLAP

SEQ ID NO: 671 - protein, 9 aa, Artificial Sequence
  Synthetic Polypeptide
  MISC_FEATURE: CDR-L3 of F12Q
VLWYSNRWV

SEQ ID NO: 672 - protein, 5 aa, Artificial Sequence
  Synthetic Polypeptide
  MISC_FEATURE: CDR-H1 of F12Q
SYAMN

SEQ ID NO: 673 - protein, 19 aa, Artificial Sequence
  Synthetic Polypeptide
  MISC_FEATURE: CDR-H2 of F12Q
RIRSKYNNYATYYADSVKG

SEQ ID NO: 674 - protein, 14 aa, Artificial Sequence
  Synthetic Polypeptide
  MISC_FEATURE: HGNFGNSYVSWWAY
HGNFGNSYVSWWAY

SEQ ID NO: 675 - protein, 125 aa, Artificial Sequence
  Synthetic Polypeptide
  MISC_FEATURE: VH of F12Q
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 676 - protein, 125 aa, Artificial Sequence
  Synthetic Polypeptide
  MISC_FEATURE: VH variant of F12Q
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSS

SEQ ID NO: 677 - protein, 109 aa, Artificial Sequence
  Synthetic Polypeptide
  MISC_FEATURE: VL of F12Q
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 678 - protein, 109 aa, Artificial Sequence
  Synthetic Polypeptide
  MISC_FEATURE: VL variant of F12Q
ELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 679 - protein, 249 aa, Artificial Sequence
  Synthetic Polypeptide
  MISC_FEATURE: scFv of F12Q
EVQLVESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 680 - protein, 249 aa, Artificial Sequence
  Synthetic Polypeptide
  MISC_FEATURE: scFv variant of F12Q
EVQLLESGGGLVQPGGSLKLSCAASGFTFNSYAMNWVRQAPGKGLEWVARIRSKYNNYATYYADSVKGRFTISRDDSKNTAYLQMNNLKTEDTAVYYCVRHGNFGNSYVSWWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 681 - protein, 125 aa, Artificial Sequence
  Synthetic Polypeptide
  MISC_FEATURE: VH of F12q
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSS

SEQ ID NO: 682 - protein, 109 aa, Artificial Sequence; identical to SEQ ID NO: 677
  Synthetic Polypeptide
  MISC_FEATURE: VL of F12q

SEQ ID NO: 683 - protein, 249 aa, Artificial Sequence
  Synthetic Polypeptide
  MISC_FEATURE: scFv of F12q
EVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 684 - protein, 14 aa, Artificial Sequence
  Synthetic Polypeptide
  MISC_FEATURE: CDR-L1 of I2C
GSSTGAVTSGNYPN

SEQ ID NO: 685 - protein, 7 aa, Artificial Sequence
  Synthetic Polypeptide
  MISC_FEATURE: CDR-L2 of I2C
GTKFLAP

SEQ ID NO: 686 - protein, 9 aa, Artificial Sequence
  Synthetic Polypeptide
  MISC_FEATURE: CDR-L3 of I2C
VLWYSNRWV

SEQ ID NO: 687 - protein, 5 aa, Artificial Sequence
  Synthetic Polypeptide
  MISC_FEATURE: CDR-H1 of I2C
KYAMN

SEQ ID NO: 688 - protein, 19 aa, Artificial Sequence
  Synthetic Polypeptide
  MISC_FEATURE: CDR-H2 of I2C
RIRSKYNNYATYYADSVKD

SEQ ID NO: 689 - protein, 14 aa, Artificial Sequence
  Synthetic Polypeptide
  MISC_FEATURE: CDR-H3 of I2C
HGNFGNSYISYWAY

SEQ ID NO: 690 - protein, 125 aa, Artificial Sequence; identical to SEQ ID NO: 596
  Synthetic Polypeptide
  MISC_FEATURE: VH of I2C

SEQ ID NO: 691 - protein, 125 aa, Artificial Sequence; identical to SEQ ID NO: 597
  Synthetic Polypeptide
  MISC_FEATURE: VH variant of I2C

SEQ ID NO: 692 - protein, 109 aa, Artificial Sequence; identical to SEQ ID NO: 677
  Synthetic Polypeptide
  MISC_FEATURE: VL of I2C

SEQ ID NO: 693 - protein, 249 aa, Artificial Sequence
  Synthetic Polypeptide
  MISC_FEATURE: scFv of I2C
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 694 - protein, 249 aa, Artificial Sequence
  Synthetic Polypeptide
  MISC_FEATURE: scFv variant of I2C
EVQLLESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSELVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 695 - protein, 504 aa, Artificial Sequence
  Synthetic Polypeptide
  MISC_FEATURE: BCMA BiTE 1
QVQLVQSGAEVKKPGASVKVSCKASGYTFTNHIIHWVRQAPGQGLEWMGYINPYPGYHAYNEKFQGRATMTSDTSTSTVYMELSSLRSEDTAVYYCARDGYYRDTDVLDYWGQGTLVTVSSGGGGSGGGGSGGGGSDIQMTQSPSSLSASVGDRVTITCQASQDISNYLNWYQQKPGKAPKLLIYYTSRLHTGVPSRFSGSGSGTDFTFTISSLEPEDIATYYCQQGNTLPWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 696 - protein, 504 aa, Artificial Sequence
  Synthetic Polypeptide
  MISC_FEATURE: BCMA BiTE 2
EVQLVESGGGLVQPGGSLRLSCAASGFTFSNFDMAWVRQAPGKGLVWVSSITTGGGDTYYADSVKGRFTISRDNAKSTLYLQMDSLRSEDTAVYYCVRHGYYDGYHLFDYWGQGTLVTVSSGGGGSGGGGSGGGGSDIQMTQSPSSLSASVGDRVTITCRANQGISNNLNWYQQKPGKAPKPLIYYTSNLQSGVPSRFSGSGSGTDYTLTISSLQPEDFATYYCQQFTSLPYTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 697 - protein, 507 aa, Artificial Sequence
  Synthetic Polypeptide
  MISC_FEATURE: BCMA BiTE 3
QVQLVQSGAEVKKPGASVKVSCKASGYSFPDYYINWVRQAPGQGLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGQGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 698 - protein, 986 aa, Artificial Sequence
  Synthetic Polypeptide
  MISC_FEATURE: BCMA HLE BiTE 1
QVQLVQSGAEVKKPGASVKVSCKASGYTFTNHIIHWVRQAPGQCLEWMGYINPYPGYHAYNEKFQGRATMTSDTSTSTVYMELSSLRSEDTAVYYCARDGYYRDTDVLDYWGQGTLVTVSSGGGGSGGGGSGGGGSDIQMTQSPSSLSASVGDRVTITCQASQDISNYLNWYQQKPGKAPKLLIYYTSRLHTGVPSRFSGSGSGTDFTFTISSLEPEDIATYYCQQGNTLPWTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 699 - protein, 986 aa, Artificial Sequence
  Synthetic Polypeptide
  MISC_FEATURE: BCMA HLE BiTE 2
EVQLVESGGGLVQPGGSLRLSCAASGFTFSNFDMAWVRQAPGKCLVWVSSITTGGGDTYYADSVKGRFTISRDNAKSTLYLQMDSLRSEDTAVYYCVRHGYYDGYHLFDYWGQGTLVTVSSGGGGSGGGGSGGGGSDIQMTQSPSSLSASVGDRVTITCRANQGISNNLNWYQQKPGKAPKPLIYYTSNLQSGVPSRFSGSGSGTDYTLTISSLQPEDFATYYCQQFTSLPYTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 700 - protein, 987 aa, Artificial Sequence
  Synthetic Polypeptide
  MISC_FEATURE: BCMA HLE BiTE 3
QVQLVQSGAEVKKPGASVKVSCKASGYSFPDYYINWVRQAPGQCLEWMGWIYFASGNSEYNQKFTGRVTMTRDTSINTAYMELSSLTSEDTAVYFCASLYDYDWYFDVWGQGTMVTVSSGGGGSGGGGSGGGGSDIVMTQTPLSLSVTPGQPASISCKSSQSLVHSNGNTYLHWYLQKPGQSPQLLIYKVSNRFSGVPDRFSGSGSGTDFTLKISRVEAEDVGIYYCSQSSIYPWTFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 701 - protein, 984 aa, Artificial Sequence
  Synthetic Polypeptide
  MISC_FEATURE: DLL3 HLE BiTE 1
QVQLQESGPGLVKPSETLSLTCTVSGGSISSYYWSWIRQPPGKGLEWIGYVYYSGTTNYNPSLKSRVTISVDTSKNQFSLKLSSVTAADTAVYYCASIAVTGFYFDYWGQGTLVTVSSGGGGSGGGGSGGGGSEIVLTQSPGTLSLSPGERVTLSCRASQRVNNNYLAWYQQRPGQAPRLLIYGASSRATGIPDRFSGSGSGTDFTLTISRLEPEDFAVYYCQQYDRSPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 702 - protein, 984 aa, Artificial Sequence
  Synthetic Polypeptide
  MISC_FEATURE: DLL3 HLE BiTE 2
QVQLQESGPGLVKPSETLSLTCTVSGASISSFYWSWIRQPPGKGLEWIGYIYYSGTTNYNPSLKSRVTISVDTSKNQFSLKLSSVTAADTAVYYCARIAVAGFFFDYWGQGTLVTVSSGGGGSGGGGSGGGGSEIVLTQSPGTLSLSPGERATLSCRASQSVNKNYLAWYQQKPGQAPRLLIYGASSRATGIPDRFSGSGSGTDFTLTISRLEPEDFAVYYCQQYDRSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 703 - protein, 993 aa, Artificial Sequence
  Synthetic Polypeptide
  MISC_FEATURE: DLL3 HLE BiTE 3
QVQLVQSGAEVKKPGASVKVSCKASGYTFTNYYMHWVRQAPGLGLEWMGIINPSDGSTSYAQKFQGRVTMTRDTSTNTVYMDLSSLRSEDTAVYYCARGGNSAFYSYYDMDVWGQGTTVTVSSGGGGSGGGGSGGGGSDVVMTQTPLSLPVTLGQPASISCRSSQSLVYRDGNTYLSWFQQRPGQSPRRLIYKVSNWQSGVPDRFSGGGSGTDFTLKISRVEAEDVGVYYCMQGTHWPPTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 704 - protein, 989 aa, Artificial Sequence
  Synthetic Polypeptide
  MISC_FEATURE: FLT3 HLE BiTE 1
QVTLKESGPTLVKPTETLTLTCTLSGFSLNNARMGVSWIRQPPGKCLEWLAHIFSNDEKSYSTSLKNRLTISKDSSKTQVVLTMTNVDPVDTATYYCARIVGYGSGWYGFFDYWGQGTLVTVSSGGGGSGGGGSGGGGSDIQMTQSPSSLSASVGDRVTITCRASQGIRNDLGWYQQKPGKAPKRLIYAASTLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 705 - protein, 989 aa, Artificial Sequence
  Synthetic Polypeptide
  MISC_FEATURE: FLT3 HLE BiTE 2
QVTLKESGPALVKPTETLTLTCTLSGFSLNNARMAVSWIRQPPGKCLEWLAHIFSNDEKSYSTSLKSRLTISKDTSKSQVVLTMTNMDPEDTATYYCARIVGYGTGWYGFFDYWGQGILVTVSSGGGGSGGGGSGGGGSDIQMTQSPSSLSASVGDRVTITCRASQGIRNDLAWYQQKPGKAPKRLIYAASSLQSGVPSRFSGSGSGTEFTLTISSLQPEDFATYYCLQHNSYPLTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 706 - protein, 989 aa, Artificial Sequence
  Synthetic Polypeptide
  MISC_FEATURE: FLT3 HLE BiTE 3
QVTLKESGPTLVKPTETLTLTCTFSGFSLRYARMGVSWIRQPPGKALEWLAHIFSNDEKSYSTSLKSRLTISKDTSKSQVVLTLTNMDPVDTATYFCARMPEYSSGWSGAFDIWGQGTMVTVSSGGGGSGGGGSGGGGSDIQMTQSPSSLSASVGDRVTITCRASQDIRNDLAWYQQKPGKAPKRLIYAASSLQSGVPSRFSGSGSGTEFTLTISSLQPEDFATYYCLQHNSYPLTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 707 - protein, 506 aa, Artificial Sequence
  Synthetic Polypeptide
  MISC_FEATURE: EGFRvIII BiTE 1
QVQLVESGGGVVQSGRSLRLSCAASGFTFRNYGMHWVRQAPGKCLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGCGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 708 - protein, 506 aa, Artificial Sequence
  Synthetic Polypeptide
  MISC_FEATURE: EGFRvIII BiTE 2
QVQLVESGGGVVQSGRSLRLSCAASGFTFRNYGMHWVRQAPGKGLEWVAVIWYDGSDKYYADSVRGRFTISRDNSKNTLYLQMNSLRAEDTAVYYCARDGYDILTGNPRDFDYWGQGTLVTVSSGGGGSGGGGSGGGGSDTVMTQTPLSSHVTLGQPASISCRSSQSLVHSDGNTYLSWLQQRPGQPPRLLIYRISRRFSGVPDRFSGSGAGTDFTLEISRVEAEDVGVYYCMQSTHVPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 709 - protein, 991 aa, Artificial Sequence
  Synthetic Polypeptide
  MISC_FEATURE: CD19 HLE BiTE 1
DIVMTQSPLSLPVISGEPASISCRSSQSLLHKNAFNYLDWYLQKPGQSPQLLIYLGSNRASGVPDRFSGSGSGTDFTLKISRVEAEDVGVYYCMQALQTPFTFGCGTKVDIKGGGGSGGGGSGGGGSQVQLVESGGGVVQPGRSLRLSCAASGFTFSSYGMHWVRQAPGKCLEWVAVISYEGSNKYYAESVKGRFTISRDNSKNTLYLQMNSLRDEDTAVYYCARDRGTIFGNYGLEVWGQGTTVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 710 - protein, 988 aa, Artificial Sequence
  Synthetic Polypeptide
  MISC_FEATURE: CD19 HLE BiTE 2
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGGGTKVEIKGGGGSGGGGSGGGGSEVQLLESGGGLVQPGGSLRLSCAASGFTFSSYGVSWVRQAPGKGLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 711 - protein, 988 aa, Artificial Sequence
  Synthetic Polypeptide
  MISC_FEATURE: CD19 HLE BiTE 3
DIQMTQSPSSLSASVGDRVTITCQASETIYSSLAWYQQKPGKPPKLLIYGASNLESGVPSRFSGSGSGTDFTFTISSLQPEDIATYYCQSGVYSAGLTFGCGTKVEIKGGGGSGGGGSGGGGSEVQLLESGGGLVQPGGSLRLSCAASGFTFSSYGVSWVRQAPGKCLEWIGYNDPVFGSIYYASWVKGRFTISSDNSKNTLYLQMNSLRAEDTAVYYCAKDRSYVSSSGYHFNLWGQGTLVTVSSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 712 - protein, 511 aa, Artificial Sequence
  Synthetic Polypeptide
  MISC_FEATURE: CD33 BiTE 1
QVQLVQSGAEVKKPGESVKVSCKASGYTFTNYGMNWVKQAPGQGLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 713 - protein, 505 aa, Artificial Sequence
  Synthetic Polypeptide
  MISC_FEATURE: CD33 BiTE 2
QVQLVQSGAEVKKPGESVKVSCKASGYTFTNYGMNWVKQAPGQGLKWMGWINTYTGEPTYADDFKGRVTMTSDTSTSTAYMEISSLRSDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 714 - protein, 505 aa, Artificial Sequence
  Synthetic Polypeptide
  MISC_FEATURE: CD33 BiTE 3
QVQLVQSGAEVKKPGESVKVSCKASGYTFTNYGMNWVKQAPGQGLKWMGWINTYTGEPTYADDFKGRVTMTTDTSTSTAYMEIRNLRNDDTAVYYCARWSWSDGYYVYFDYWGQGTTVTVSSGGGGSGGGGSGGGGSDIVMTQSPDSLTVSLGERTTINCKSSQSVLDSSKNKNSLAWYQQKPGQPPKLLLSWASTRESGIPDRFSGSGSGTDFTLTIDSLQPEDSATYYCQQSAHFPITFGQGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 715 - protein, 993 aa, Artificial Sequence
  Synthetic Polypeptide
  MISC_FEATURE: CD33 HLE BiTE 1
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 716 - protein, 991 aa, Artificial Sequence
  Synthetic Polypeptide
  MISC_FEATURE: CD33 HLE BiTE 2
QVQLVQSGAEVKKPGESVKVSCKASGYTFTNYGMNWVKQAPGQCLEWMGWINTYTGEPTYADKFQGRVTMTTDTSTSTAYMEIRNLGGDDTAVYYCARWSWSDGYYVYFDYWGQGTSVTVSSGGGGSGGGGSGGGGSDIVMTQSPDSLTVSLGERTTINCKSSQSVLDSSTNKNSLAWYQQKPGQPPKLLLSWASTRESGIPDRFSGSGSGTDFTLTIDSPQPEDSATYYCQQSAHFPITFGCGTRLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 717 - protein, 993 aa, Artificial Sequence; identical to SEQ ID NO: 715
  Synthetic Polypeptide
  MISC_FEATURE: CD33 HLE BiTE 3

SEQ ID NO: 718 - protein, 498 aa, Artificial Sequence
  Synthetic Polypeptide
  MISC_FEATURE: PSMA BiTE 1
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 719 - protein, 498 aa, Artificial Sequence
  Synthetic Polypeptide
  MISC_FEATURE: PSMA BiTE 2
QVQLVESGGGLVKPGGSLRLSCAASGFTFSDYYMYWVRQAPGKGLEWVAIISDGGYYTYYSDIIKGRFTISRDNAKNNLYLQMNSLRAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 720 - protein, 501 aa, Artificial Sequence
  Synthetic Polypeptide
  MISC_FEATURE: PSMA BiTE 3
QVQLVQSGAEVKKPGASVKLSCKASGYTFTYFDINWVRQAPEQGLEWMGGISPGDGNTNYNENFKGRVTMTIDTSSSTAYIELSRLTSDDTAVYYCARDGNFPYYAMDSWGQGTTVTVSSGGGGSGGGGSGGGGSDIVMTQSPLSLPVTLGQQASISCRSSQSLVHSNGNTYLHWFQQRPGQSPKLLIYTVSNRFSGVPDRFSGSGSGTDFTLKISRVEAEDVGVYYCSQSTHVPTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 721 - protein, 986 aa, Artificial Sequence
  Synthetic Polypeptide
  MISC_FEATURE: PSMA HLE BiTE 1
QVQLVESGGGLVKPGESLRLSCAASGFTFSDYYMYWVRQAPGKCLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 722 - protein, 986 aa, Artificial Sequence
  Synthetic Polypeptide
  MISC_FEATURE: PSMA HLE BiTE 2
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 723 - protein, 984 aa, Artificial Sequence
  Synthetic Polypeptide
  MISC_FEATURE: PSMA HLE BiTE 3
QVQLVESGGGLVKPGESLRLSCAASGFTFSDYYMYWVRQAPGKCLEWVAIISDAGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDANVAWYQQKPGQAPKSLIYSASYVYWDVPSRFSGSASGTDFTLTISSVQSEDFATYYCQQYDQQLITFGCGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYCGQGTLVTVSSGGGGSGGGGSGGGGSQTVVTQEPSLTVSPGGTVTLTCGSSTGAVTSGNYPNWVQQKPGQCPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 724 - protein, 984 aa, Artificial Sequence
  Synthetic Polypeptide
  MISC_FEATURE: MUC17 HLE BiTE 1
QVQLQQWGAGLLKPSETLSLTCAVYGGSFSGYYWSWIRQPPGKCLEWIGDIDASGSTKYNPSLKSRVTISLDTSKNQFSLKLNSVTAADTAVYFCARKKYSTVWSYFDNWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 725 - protein, 984 aa, Artificial Sequence
  Synthetic Polypeptide
  MISC_FEATURE: MUC17 HLE BiTE 2
QVQLQQWGAGLLKPSETLSLTCAVYGGSFSGYYWSWIRQPPGKCLEWIGDIDQSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVPPGQTASITCSGDKLGDKYASWYQQKPGQSPVLVIYQDRKRPSGVPERFSGSNSGNTATLTISGTQAMDEADYYCQAWGSSTAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 726 - protein, 984 aa, Artificial Sequence
  Synthetic Polypeptide
  MISC_FEATURE: MUC17 HLE BiTE 3
QVQLQQWGAGLLKPSETLSLTCAVYGGSFSGYYWSWIRQPPGKCLEWIGDIDYSGSTKYNPSLKSRVTISLDTSKNQFSLKLNSVTAADTAVYFCARKKYSTVWSYFDYWGQGTLVTVSSGGGGSGGGGSGGGGSSYELTQPSSVSVSPGQTASITCSGDKLGEKYASWYQQKPGQSPVLIIYQDRKRPSGVPERFSGSNSGNTATLTISGTQAMDEADYYCQAWGSSAAVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSGGGGSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 727 - protein, 515 aa, Artificial Sequence
  Synthetic Polypeptide
  MISC_FEATURE: EpCAM BiTE 1
MGWSCIILFLVATATGVHSELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 728 - protein, 500 aa, Artificial Sequence
  Synthetic Polypeptide
  MISC_FEATURE: EpCAM BiTE 2
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSEVQLLEQSGAELVRPGTSVKLSCKASGYTFTSYGLSWVKQRTGQGLEWIGEVYPRIGNAYYNEKFKGKATLTADKSSSTASMELRSLTSEDSAVYFCARRGSYGSNYDWYFDVWGQGTTVTVSSGGGGSGGGGSGGGGSELVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPYTFGGGTKLEIK

SEQ ID NO: 729 - protein, 497 aa, Artificial Sequence
  Synthetic Polypeptide
  MISC_FEATURE: EpCAM BiTE 3
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKSGGGGSEVQLLEQSGAELVRPGTSVKISCKASGYAFTNYWLGWVKQRPGHGLEWVGDIFPGSGNAHYNEKFKGKATLTADKSSYTAYMQLSSLTSEDSAVYFCARLRNWDEAMDYWGQGTTVTVSSGGGGSGGGGSGGGGSELVMTQSPSSLSVSAGEKVTMSCKSSQSLLNSGNQKNYLAWYQQKPGQPPKLLIYGASTRESGVPDRFTGSGSGTDFTLTISSVQAEDLAVYYCQNDYSYPYTFGGGTKLEIK

SEQ ID NO: 730 - protein, 5 aa, Artificial Sequence
  Synthetic Polypeptide
  MISC_FEATURE: CDR1 DLL3
GYYMH

SEQ ID NO: 731 - protein, 16 aa, Artificial Sequence
  Synthetic Polypeptide
YIYYSGTTNYNPSLKS

SEQ ID NO: 732 - protein, 17 aa, Artificial Sequence
  Synthetic Polypeptide
WIDPNSGDTNYAQKFQG

SEQ ID NO: 733 - protein, 17 aa, Artificial Sequence
  Synthetic Polypeptide
WINPNSGDTSYAQRFLG

SEQ ID NO: 734 - protein, 10 aa, Artificial Sequence
  Synthetic Polypeptide
IAVRGFFFDY

SEQ ID NO: 735 - protein, 13 aa, Artificial Sequence
  Synthetic Polypeptide
DPNRRSWYYGMDV

SEQ ID NO: 736 - protein, 12 aa, Artificial Sequence
  Synthetic Polypeptide
EDDSSWYGSFDY

SEQ ID NO: 737 - protein, 12 aa, Artificial Sequence
  Synthetic Polypeptide
RASQSVSSSYLA

SEQ ID NO: 738 - protein, 11 aa, Artificial Sequence
  Synthetic Polypeptide
QASQDIRNYLN

SEQ ID NO: 739 - protein, 11 aa, Artificial Sequence
  Synthetic Polypeptide
RASQGIRNYLG

SEQ ID NO: 740 - protein, 7 aa, Artificial Sequence
  Synthetic Polypeptide
GASTRAT

SEQ ID NO: 741 - protein, 7 aa, Artificial Sequence
  Synthetic Polypeptide
DASNLET

SEQ ID NO: 742 - protein, 7 aa, Artificial Sequence
  Synthetic Polypeptide
AASSLQS

SEQ ID NO: 743 - protein, 9 aa, Artificial Sequence
  Synthetic Polypeptide
QQYGTSPLT

SEQ ID NO: 744 - protein, 10 aa, Artificial Sequence
  Synthetic Polypeptide
QHYDNLPLTF

SEQ ID NO: 745 - protein, 10 aa, Artificial Sequence
  Synthetic Polypeptide
LQHDSDLRTF

SEQ ID NO: 746 - protein, 482 aa, Artificial Sequence
  Synthetic Polypeptide
  MISC_FEATURE: Construct 1H2.1 4-1BB AA
MALPVTALLLPLALLLHAARPQVQLQESGPGLVKPSETLSLTCTVSGDSISSYYWTWIRQPPGKGLEWIGYIYYSGTTNYNPSLKSRVTISVDTSKSQFSLKLSSVTAADTAVYYCASIAVRGFFFDYWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGTSPLTFGGGTKVEIKRAAALDNEKSNGTIIHVKGKHLCPSPLFPGPSKPFWVLVVVGGVLACYSLLVTVAFIIFWVRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 747 - protein, 476 aa, Artificial Sequence
  Synthetic Polypeptide
  MISC_FEATURE: Construct 1H2.1 CD28T AA
MALPVTALLLPLALLLHAARPQVQLQESGPGLVKPSETLSLTCTVSGDSISSYYWTWIRQPPGKGLEWIGYIYYSGTTNYNPSLKSRVTISVDTSKSQFSLKLSSVTAADTAVYYCASIAVRGFFFDYWGQGTLVTVSSGGGGSGGGGSGGGGSEIVLTQSPGTLSLSPGERATLSCRASQSVSSSYLAWYQQKPGQAPRLLIYGASTRATGIPDRFSGSGSGTDFTLTISRLEPEDFAVYYCQQYGTSPLTFGGGTKVEIKRAAALDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 748 - protein, 485 aa, Artificial Sequence
  Synthetic Polypeptide
  MISC_FEATURE: Construct 8D2 4-1BB AA
MALPVTALLLPLALLLHAARPQVQLVQSGAEVKRPGASVKVSCKASGYTFTGYYMHWVRQAPGQGLEWMGWIDPNSGDTNYAQKFQGRVTMTRDTSISTAYMEVNRLRSDDTAVYYCARDPNRRSWYYGMDVWAQGTTVTVSSGGGGSGGGGSGGGGSDIQMTQSPSSLSASVGDRVTITCQASQDIRNYLNWYQQKPGKAPKLLIYDASNLETGVPSRFSGSGSGTDFTFTISTLQPEDIATYYCQHYDNLPLTFGGGTKVEIRRAAALDNEKSNGTIIHVKGKHLCPSPLFPGPSKPFWVLVVVGGVLACYSLLVTVAFIIFWVRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 749 - protein, 479 aa, Artificial Sequence
  Synthetic Polypeptide
  MISC_FEATURE: Construct 8D2 CD28T AA
MALPVTALLLPLALLLHAARPQVQLVQSGAEVKRPGASVKVSCKASGYTFTGYYMHWVRQAPGQGLEWMGWIDPNSGDTNYAQKFQGRVTMTRDTSISTAYMEVNRLRSDDTAVYYCARDPNRRSWYYGMDVWAQGTTVTVSSGGGGSGGGGSGGGGSDIQMTQSPSSLSASVGDRVTITCQASQDIRNYLNWYQQKPGKAPKLLIYDASNLETGVPSRFSGSGSGTDFTFTISTLQPEDIATYYCQHYDNLPLTFGGGTKVEIRRAAALDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 750 - protein, 478 aa, Artificial Sequence
  Synthetic Polypeptide
  MISC_FEATURE: Construct 6B2 CD28T AA
MALPVTALLLPLALLLHAARPQVQLVQSGAEVKKPGASVKVSCKASGYTFTGYYMHWVRQAPGQGLEWMGWINPNSGDTSYAQRFLGRVTMTRDTSINTVHMELSRLGSDDTAVYYCAREDDSSWYGSFDYWGQGTLVTVSSGGGGSGGGGSGGGGSDIQMTQSPSSLSASVGDRVTITCRASQGIRNYLGWYQQKPGKAPKRLIYAASSLQSGVPSKFSGSGSGTEFTLTISSLQPEDFATYYCLQHDSDLRTFGQGTKVEIKRAAALDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 751 - protein, 484 aa, Artificial Sequence
  Synthetic Polypeptide
  MISC_FEATURE: Construct 6B2 4-1BB AA
MALPVTALLLPLALLLHAARPQVQLVQSGAEVKKPGASVKVSCKASGYTFTGYYMHWVRQAPGQGLEWMGWINPNSGDTSYAQRFLGRVTMTRDTSINTVHMELSRLGSDDTAVYYCAREDDSSWYGSFDYWGQGTLVTVSSGGGGSGGGGSGGGGSDIQMTQSPSSLSASVGDRVTITCRASQGIRNYLGWYQQKPGKAPKRLIYAASSLQSGVPSKFSGSGSGTEFTLTISSLQPEDFATYYCLQHDSDLRTFGQGTKVEIKRAAALDNEKSNGTIIHVKGKHLCPSPLFPGPSKPFWVLVVVGGVLACYSLLVTVAFIIFWVRFSVVKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 752 - protein, 7 aa, Artificial Sequence
  Synthetic Polypeptide
NARMGVS

SEQ ID NO: 753 - protein, 16 aa, Artificial Sequence
  Synthetic Polypeptide
HIFSNAEKSYRTSLKS

SEQ ID NO: 754 - protein, 16 aa, Artificial Sequence
  Synthetic Polypeptide
HIFSNDEKTYSTSLKS

SEQ ID NO: 755 - protein, 17 aa, Artificial Sequence
  Synthetic Polypeptide
IPGYGGNGDYHYYGMDV

SEQ ID NO: 756 - protein, 15 aa, Artificial Sequence
  Synthetic Polypeptide
IPYYGSGSHNYGMDV

SEQ ID NO: 757 - protein, 11 aa, Artificial Sequence
  Synthetic Polypeptide
RASQGIRNDLG

SEQ ID NO: 758 - protein, 11 aa, Artificial Sequence
  Synthetic Polypeptide
RASQDIRNDFG

SEQ ID NO: 759 - protein, 7 aa, Artificial Sequence
  Synthetic Polypeptide
ASSTLQS

SEQ ID NO: 760 - protein, 7 aa, Artificial Sequence
  Synthetic Polypeptide
AASTLQS

SEQ ID NO: 761 - protein, 9 aa, Artificial Sequence
  Synthetic Polypeptide
LQHNNFPWT

SEQ ID NO: 762 - protein, 9 aa, Artificial Sequence
  Synthetic Polypeptide
LQYNTYPWT

SEQ ID NO: 763 - protein, 493 aa, Artificial Sequence
  Synthetic Polypeptide
  MISC_FEATURE: Construct 10E3 CD28 AA
MALPVTALLLPLALLLHAARPQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 764 - protein, 484 aa, Artificial Sequence
  Synthetic Polypeptide
  MISC_FEATURE: Construct 10E3 CD28T AA
MALPVTALLLPLALLLHAARPQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRAAALDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 765 - protein, 520 aa, Artificial Sequence
  Synthetic Polypeptide
  MISC_FEATURE: Construct 10E3 CD8 AA
MALPVTALLLPLALLLHAARPQVTLKESGPVLVKPTETLTLTCTVSGFSLINARMGVSWIRQPPGKALEWLAHIFSNAEKSYRTSLKSRLTISKDTSKSQVVLTMTNMDPVDTATYYCARIPGYGGNGDYHYYGMDVWGQGTTVTVSSGGGGSGGGGSGGGGSDIQMTQSPSSLSASLGDRVTITCRASQGIRNDLGWYQQKPGKAPKRLIYASSTLQSGVPSRFSGSGSGTEFTLTISSLQPEDFATYYCLQHNNFPWTFGQGTKVEIKRAAALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 766 - protein, 487 aa, Artificial Sequence
  Synthetic Polypeptide
  MISC_FEATURE: Construct 8B5 CD28 AA
MALPVTALLLPLALLLHAARPQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 767 - protein, 478 aa, Artificial Sequence
  Synthetic Polypeptide
  MISC_FEATURE: Construct 8B5 CD28T AA
MALPVTALLLPLALLLHAARPQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRAAALDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 768 - protein, 514 aa, Artificial Sequence
  Synthetic Polypeptide
  MISC_FEATURE: Construct 8B5 CD8 AA
MALPVTALLLPLALLLHAARPQIQLVESGGGVVQPGRSLRLSCVASGFTFKNYGMHWVRQAPGKGLEWVAVIWYDGSNEYYGDPVKGRFTISRDNSKNMLYLQMNSLRADDTAVYYCARSGIAVAGAFDYWGQGTLVTVSSGGGGSGGGGSGGGGSEIVLTQSPDTLSLSPGEKATLSCRASQSVSSSFLAWYQQKPGQAPSLLIYVASRRAAGIPDRFSGSGSGTDFTLTISRLEPEDFGMFYCQHYGRTPFTFGPGTKVDIKRAAALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 769 - protein, 491 aa, Artificial Sequence
  Synthetic Polypeptide
  MISC_FEATURE: Construct 4E9 CD28 AA
MALPVTALLLPLALLLHAARPQVQLVQSGAEVKKPGASVKVSCKASGYTFTGYYIHWVRQAPEQGLEWMGWINPNSGGTNYAQKFQGRVTMARDTSISTVYMDLSRLRSDDTAVYYCARIRGGNSVFDYWGQGTLVTVSSGGGGSGGGGSGGGGSDIVMTQSPDSLAVSLGERATINCKSTQSILYTSNNKNFLAWYQQKPGQPPKLLISWASIRESGVPDRFSGSGSGTDFALTISSLQAEDVAVYYCQQYFSTMFSFGQGTKLEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 770 - protein, 482 aa, Artificial Sequence
  Synthetic Polypeptide
  MISC_FEATURE: Construct 4E9 CD28T AA
MALPVTALLLPLALLLHAARPQVQLVQSGAEVKKPGASVKVSCKASGYTFTGYYIHWVRQAPEQGLEWMGWINPNSGGTNYAQKFQGRVTMARDTSISTVYMDLSRLRSDDTAVYYCARIRGGNSVFDYWGQGTLVTVSSGGGGSGGGGSGGGGSDIVMTQSPDSLAVSLGERATINCKSTQSILYTSNNKNFLAWYQQKPGQPPKLLISWASIRESGVPDRFSGSGSGTDFALTISSLQAEDVAVYYCQQYFSTMFSFGQGTKLEIKRAAALDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 771 - protein, 518 aa, Artificial Sequence
  Synthetic Polypeptide
  MISC_FEATURE: Construct 4E9 CD8 AA
MALPVTALLLPLALLLHAARPQVQLVQSGAEVKKPGASVKVSCKASGYTFTGYYIHWVRQAPEQGLEWMGWINPNSGGTNYAQKFQGRVTMARDTSISTVYMDLSRLRSDDTAVYYCARIRGGNSVFDYWGQGTLVTVSSGGGGSGGGGSGGGGSDIVMTQSPDSLAVSLGERATINCKSTQSILYTSNNKNFLAWYQQKPGQPPKLLISWASIRESGVPDRFSGSGSGTDFALTISSLQAEDVAVYYCQQYFSTMFSFGQGTKLEIKRAAALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 772 - protein, 486 aa, Artificial Sequence
  Synthetic Polypeptide
  MISC_FEATURE: Construct 11F11 CD28 AA
MALPVTALLLPLALLLHAARPQVQLQESGPGLVKPSQTLSLTCTVSGGSISSGAYYWTWIRQHPGKGLEWIGYIHYSGSTYSNPSLKSRITISLDTSKNQFSLKLNSVTAADTAVYYCARQEDYGGLFDYWGQGTLVTVSSGGGGSGGGGSGGGGSEIVMTQSPATLSVSPGERITLSCRASQSVTTDLAWYQQMPGQAPRLLIYDASTRATGFPARFSGSGSGTDFTLTISSLQAEDFAVYYCQHYKTWPLTFGGGTKVEIKRAAAIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 773 - protein, 477 aa, Artificial Sequence
  Synthetic Polypeptide
  MISC_FEATURE: Construct 11F11 CD28T AA
MALPVTALLLPLALLLHAARPQVQLQESGPGLVKPSQTLSLTCTVSGGSISSGAYYWTWIRQHPGKGLEWIGYIHYSGSTYSNPSLKSRITISLDTSKNQFSLKLNSVTAADTAVYYCARQEDYGGLFDYWGQGTLVTVSSGGGGSGGGGSGGGGSEIVMTQSPATLSVSPGERITLSCRASQSVTTDLAWYQQMPGQAPRLLIYDASTRATGFPARFSGSGSGTDFTLTISSLQAEDFAVYYCQHYKTWPLTFGGGTKVEIKRAAALDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 774 - protein, 513 aa, Artificial Sequence
  Synthetic Polypeptide
  MISC_FEATURE: Construct 11F11 CD8 AA
MALPVTALLLPLALLLHAARPQVQLQESGPGLVKPSQTLSLTCTVSGGSISSGAYYWTWIRQHPGKGLEWIGYIHYSGSTYSNPSLKSRITISLDTSKNQFSLKLNSVTAADTAVYYCARQEDYGGLFDYWGQGTLVTVSSGGGGSGGGGSGGGGSEIVMTQSPATLSVSPGERITLSCRASQSVTTDLAWYQQMPGQAPRLLIYDASTRATGFPARFSGSGSGTDFTLTISSLQAEDFAVYYCQHYKTWPLTFGGGTKVEIKRAAALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

What is claimed is:

1. A PD-1 antigen-binding protein comprising six complementarity-determining region amino acid sequences selected from the group consisting of: (a) SEQ ID NOs: 352-357; (b) SEQ ID NOs: 322-327; (c) SEQ ID NOs: 332-337; (d) SEQ ID NOs: 342-347; (e) SEQ ID NOs: 312-317; and (f) SEQ ID NOs: 372-377.

2. The PD-1 antigen-binding protein of claim 1, comprising: (a) a heavy chain (HC) variable region of SEQ ID NO: 358 and a light chain (LC) variable region of SEQ ID NO: 359; (b) a HC variable region of SEQ ID NO: 328 and a LC variable region of SEQ ID NO: 329; (c) a HC variable region of SEQ ID NO: 338 and a LC variable region of SEQ ID NO: 339; (d) a HC variable region of SEQ ID NO: 348 and a LC variable region of SEQ ID NO: 349; (e) a HC variable region of SEQ ID NO: 318 and a LC variable region of SEQ ID NO: 319; or (f) a HC variable region of SEQ ID NO: 378 and a LC variable region of SEQ ID NO: 379.

3. The PD-1 antigen-binding protein of claim 2, comprising: (a) a heavy chain of SEQ ID NO: 360 and a light chain of SEQ ID NO: 361; (b) a heavy chain of SEQ ID NO: 330 and a light chain of SEQ ID NO: 331; (c) a heavy chain of SEQ ID NO: 340 and a light chain of SEQ ID NO: 341; (d) a heavy chain of SEQ ID NO: 350 and a light chain of SEQ ID NO: 351; (e) a heavy chain of SEQ ID NO: 320 and a light chain of SEQ ID NO: 321; or (f) a heavy chain of SEQ ID NO: 380 and a light chain of SEQ ID NO: 381.

4. The PD-1 antigen-binding protein of any one of claims 1 to 3, wherein said antigen-binding protein is an antibody or an antigen-binding fragment thereof.

5. The PD-1 antigen-binding protein of claim 1, wherein said antigen-binding protein is an antibody.

6. The PD-1 antigen-binding protein of claim 1, wherein said antigen-binding protein is an antibody protein product.

7. A PD-1 antigen-binding protein comprising a heavy chain (HC) complementarity-determining region (CDR) 1 amino acid sequence comprising SEQ ID NO: 352; an HC CDR2 amino acid sequence comprising SEQ ID NO: 353; an HC CDR3 amino acid sequence comprising SEQ ID NO: 354; a light chain (LC) CDR1 amino acid sequence comprising SEQ ID NO: 355; an LC CDR2 amino acid sequence comprising SEQ ID NO: 356; and an LC CDR3 amino acid sequence comprising SEQ ID NO: 357;

an HC CDR1 amino acid sequence comprising SEQ ID NO: 322; an HC CDR2 amino acid sequence comprising SEQ ID NO: 323; an HC CDR3 amino acid sequence comprising SEQ ID NO: 324; an LC CDR1 amino acid sequence comprising SEQ ID NO: 325; an LC CDR2 amino acid sequence comprising SEQ ID NO: 326; and an LC CDR3 amino acid sequence comprising SEQ ID NO: 327;

an HC CDR1 amino acid sequence comprising SEQ ID NO: 332; an HC CDR2 amino acid sequence comprising SEQ ID NO: 333; an HC CDR3 amino acid sequence comprising SEQ ID NO: 334; an LC CDR1 amino acid sequence comprising SEQ ID NO: 335; an LC CDR2 amino acid sequence comprising SEQ ID NO: 336; and an LC CDR3 amino acid sequence comprising SEQ ID NO: 337;

an HC CDR1 amino acid sequence comprising SEQ ID NO: 342; an HC CDR2 amino acid sequence comprising SEQ ID NO: 343; an HC CDR3 amino acid sequence comprising SEQ ID NO: 344; an LC CDR1 amino acid sequence comprising SEQ ID NO: 345; an LC CDR2 amino acid sequence comprising SEQ ID NO: 346; and an LC CDR3 amino acid sequence comprising SEQ ID NO: 347;

an HC CDR1 amino acid sequence comprising SEQ ID NO: 312; an HC CDR2 amino acid sequence comprising SEQ ID NO: 313; an HC CDR3 amino acid sequence comprising SEQ ID NO: 314; an LC CDR1 amino acid sequence comprising SEQ ID NO: 315; an LC CDR2 amino acid sequence comprising SEQ ID NO: 316; and an LC CDR3 amino acid sequence comprising SEQ ID NO: 317; or an HC CDR1 amino acid sequence comprising SEQ ID NO: 372; an HC CDR2 amino acid sequence comprising SEQ ID NO: 373; an HC CDR3 amino acid sequence comprising SEQ ID NO: 374; an LC CDR1 amino acid sequence comprising SEQ ID NO: 375; an LC CDR2 amino acid sequence comprising SEQ ID NO: 376; and an LC CDR3 amino acid sequence comprising SEQ ID NO: 377.

8. The PD-1 antigen-binding protein of claim 7, which is an antibody.

9. An antibody comprising a heavy chain (HC) complementarity-determining region (CDR) 1 amino acid sequence comprising SEQ ID NO: 352; an HC CDR2 amino acid sequence comprising SEQ ID NO: 353; an HC CDR3 amino acid sequence comprising SEQ ID NO: 354; a light chain (LC) CDR1 amino acid sequence comprising SEQ ID NO: 355; an LC CDR2 amino acid sequence comprising SEQ ID NO: 356; and an LC CDR3 amino acid sequence comprising SEQ ID NO: 357.

10. The antibody of claim 9, comprising a heavy chain variable region of SEQ ID NO: 358 and a light chain variable region of SEQ ID NO: 359.

11. The antibody of claim 10, comprising a heavy chain constant region of SEQ ID NO: 265 or SEQ ID NO: 266.

12. The antibody of claim 10, comprising a human kappa light chain constant region.

13. The antibody of claim 12, comprising a light chain constant region of SEQ ID NO: 361.

14. The antibody of claim 13, comprising a heavy chain of SEQ ID NO: 360 and a light chain of SEQ ID NO: 361.

15. A pharmaceutical composition comprising the antibody of claim 9 and a pharmaceutically acceptable carrier, excipient, or diluent.

16. A kit comprising the antibody of claim 9 and a container.

17. The PD-1 antigen-binding protein of claim 6, wherein the antibody protein product is an scFv.

18. A kit comprising (a) an PD-1 antigen-binding protein of any one of claims 1, 3, 5, 6, 7 and 8 and (b) a container.

19. A pharmaceutical composition comprising a PD-1 antigen-binding protein of claim any one of claims 1, 3, 5, 6, 7 and 8 and a pharmaceutically acceptable carrier, excipient, or diluent.

20. A method of treating a subject in need thereof, said method comprising administering to the subject in need thereof a pharmaceutical composition of claim 19 in an amount effective to treat the subject.

21. The method of claim 20, wherein the subject has a solid tumor and the pharmaceutical composition is administered to the subject in an amount effective to treat the solid tumor in the subject.

* * * * *